(12) United States Patent
Douchin et al.

(10) Patent No.: US 10,421,983 B2
(45) Date of Patent: Sep. 24, 2019

(54) PRODUCTION OF STEVIOL GLYCOSIDES IN RECOMBINANT HOSTS

(71) Applicant: Evolva SA, Reinach (CH)

(72) Inventors: Veronique Douchin, Frederiksberg (DK); Michael Dalgaard Mikkelsen, Vaerlose (DK); Iben Møller-Hansen, Frederiksberg (DK)

(73) Assignee: EVOLVA SA, Reinach (CH)

( * ) Notice: Subject to any disclaimer, the term of this patent is extended or adjusted under 35 U.S.C. 154(b) by 69 days.

(21) Appl. No.: 15/328,365

(22) PCT Filed: Aug. 7, 2015

(86) PCT No.: PCT/EP2015/068314
§ 371 (c)(1),
(2) Date: Jan. 23, 2017

(87) PCT Pub. No.: WO2016/023844
PCT Pub. Date: Feb. 18, 2016

(65) Prior Publication Data
US 2017/0218418 A1  Aug. 3, 2017

Related U.S. Application Data

(60) Provisional application No. 62/035,902, filed on Aug. 11, 2014.

(51) Int. Cl.
| | |
|---|---|
| *C12P 21/06* | (2006.01) |
| *C12P 19/44* | (2006.01) |
| *C07H 1/08* | (2006.01) |
| *A23L 27/30* | (2016.01) |
| *C12N 1/16* | (2006.01) |

(52) U.S. Cl.
CPC ............. *C12P 19/44* (2013.01); *A23L 27/36* (2016.08); *C07H 1/08* (2013.01); *C12N 1/16* (2013.01)

(58) Field of Classification Search
None
See application file for complete search history.

(56) References Cited

U.S. PATENT DOCUMENTS

| | | |
|---|---|---|
| 4,590,160 A | 5/1986 | Nishihashi et al. |
| 5,204,253 A | 4/1993 | Sanford et al. |
| 5,306,862 A | 4/1994 | Chappell et al. |
| 5,460,949 A | 10/1995 | Saunders et al. |
| 5,538,880 A | 7/1996 | Lundquist et al. |
| 6,013,863 A | 1/2000 | Lundquist et al. |
| 6,215,051 B1 | 4/2001 | Yu et al. |
| 6,255,557 B1 | 7/2001 | Brandle |
| 6,284,493 B1 | 9/2001 | Roth |
| 6,284,506 B1 | 9/2001 | Hoshino et al. |
| 6,329,571 B1 | 12/2001 | Hiei |
| 6,586,202 B2 | 7/2003 | Hoshino et al. |
| 6,660,507 B2 | 12/2003 | Cheng et al. |
| 6,806,076 B1 | 10/2004 | Miyake et al. |
| 6,969,595 B2 | 11/2005 | Brzostowicz et al. |
| 7,034,140 B2 | 4/2006 | Bramucci et al. |
| 7,056,717 B2 | 6/2006 | Cheng et al. |
| 7,098,000 B2 | 8/2006 | Cheng et al. |
| 7,129,392 B2 | 10/2006 | Hahn et al. |
| 7,132,268 B2 | 11/2006 | Miyake et al. |
| 7,172,886 B2 | 2/2007 | Keasling et al. |
| 7,183,089 B2 | 2/2007 | Keasling et al. |
| 7,186,891 B1 | 3/2007 | Chappell et al. |
| 7,208,298 B2 | 4/2007 | Miyake et al. |
| 7,335,815 B2 | 2/2008 | Boronat et al. |
| 7,364,885 B2 | 4/2008 | Miyake et al. |
| 7,422,884 B2 | 9/2008 | Bai et al. |
| 7,514,597 B2 | 4/2009 | Nakamura et al. |
| 7,569,389 B2 | 9/2009 | Feldmann et al. |
| 7,692,065 B2 | 4/2010 | Harper et al. |
| 7,838,287 B2 | 11/2010 | Goldsmith et al. |
| 7,923,541 B2 | 4/2011 | Yang et al. |
| 7,927,851 B2 | 4/2011 | Brandle et al. |
| 9,562,251 B2 | 2/2017 | Kishore et al. |
| 2002/0142408 A1 | 10/2002 | DiCosimo et al. |
| 2003/0033626 A1 | 2/2003 | Hahn et al. |
| 2003/0148416 A1 | 8/2003 | Berry et al. |
| 2003/0148479 A1 | 8/2003 | Keasling et al. |
| 2003/0190734 A1 | 10/2003 | Hoshino et al. |
| 2003/0219798 A1 | 11/2003 | Gokarn et al. |
| 2004/0010815 A1 | 1/2004 | Lange et al. |
| 2004/0072311 A1 | 4/2004 | DiCosimo et al. |
| 2004/0078846 A1 | 4/2004 | Desouza et al. |
| 2004/0176570 A1 | 9/2004 | Bacher et al. |
| 2004/0194162 A1 | 9/2004 | Hahn et al. |
| 2005/0003474 A1 | 1/2005 | Desouza |
| 2005/0032169 A1 | 2/2005 | Miyake et al. |
| 2006/0014264 A1 | 1/2006 | Sauer |
| 2006/0079476 A1 | 4/2006 | Keasling et al. |
| 2006/0083838 A1 | 4/2006 | Jackson et al. |
| 2007/0004000 A1 | 1/2007 | Miyake et al. |
| 2007/0077616 A1 | 4/2007 | Keasling et al. |
| 2007/0099261 A1 | 5/2007 | Keasling et al. |
| 2007/0118916 A1* | 5/2007 | Puzio ................ C12N 15/8214 800/278 |
| 2007/0128311 A1 | 6/2007 | Prakash et al. |
| 2007/0166782 A1 | 7/2007 | Keasling et al. |
| 2007/0202579 A1 | 8/2007 | Berry et al. |

(Continued)

FOREIGN PATENT DOCUMENTS

| | | |
|---|---|---|
| CN | 101720910 | 6/2010 |
| CN | 102216313 | 10/2011 |

(Continued)

OTHER PUBLICATIONS

Chen, "Summary on Study of Stevioside," China Pharmacist, vol. 10, No. 6, p. 598-599 (2007). (English abstract).

(Continued)

*Primary Examiner* — Jennifer E Graser
(74) *Attorney, Agent, or Firm* — McDonnell Boehnen Hulbert & Berghoff LLP

(57) ABSTRACT

The invention relates to recombinant microorganisms and methods for producing steviol glycosides and steviol glycoside precursors.

25 Claims, 11 Drawing Sheets
Specification includes a Sequence Listing.

(56) References Cited

U.S. PATENT DOCUMENTS

| | | | |
|---|---|---|---|
| 2007/0238157 | A1 | 10/2007 | Millis et al. |
| 2007/0238159 | A1 | 10/2007 | Millis et al. |
| 2007/0238160 | A1 | 10/2007 | Millis et al. |
| 2007/0254354 | A1 | 11/2007 | Millis et al. |
| 2007/0269857 | A1 | 11/2007 | Miyake et al. |
| 2007/0286850 | A1 | 12/2007 | Bai et al. |
| 2008/0064063 | A1 | 3/2008 | Brandle |
| 2008/0081358 | A1 | 4/2008 | Vittanen et al. |
| 2008/0131926 | A1 | 6/2008 | Miyake et al. |
| 2008/0261280 | A1 | 10/2008 | Hahn et al. |
| 2008/0271205 | A1 | 10/2008 | Yamaguchi et al. |
| 2008/0286870 | A1 | 11/2008 | Vittanen et al. |
| 2008/0292775 | A1 | 11/2008 | Prakash et al. |
| 2008/0318227 | A1 | 12/2008 | Bacher et al. |
| 2009/0004724 | A1 | 1/2009 | Keasling et al. |
| 2009/0047718 | A1 | 2/2009 | Blaschek et al. |
| 2009/0055974 | A1 | 2/2009 | Tanksley et al. |
| 2009/0074935 | A1 | 3/2009 | Lee |
| 2009/0286262 | A1 | 11/2009 | Slack |
| 2010/0112156 | A1 | 5/2010 | Abelyan et al. |
| 2010/0120096 | A1 | 5/2010 | Kitaoka et al. |
| 2010/0221801 | A1 | 9/2010 | Van Dyk |
| 2010/0297722 | A1 | 11/2010 | Anterola et al. |
| 2010/0316782 | A1 | 12/2010 | Shi et al. |
| 2011/0087011 | A1 | 4/2011 | Chiang et al. |
| 2011/0092684 | A1 | 4/2011 | Abelyan et al. |
| 2011/0126318 | A1 | 5/2011 | Allen et al. |
| 2011/0160311 | A1 | 6/2011 | Prakash et al. |
| 2012/0021111 | A1 | 1/2012 | Pfister et al. |
| 2012/0083593 | A1 | 4/2012 | Liu et al. |
| 2012/0164678 | A1 | 6/2012 | Stephanopoulos et al. |
| 2012/0178169 | A1 | 7/2012 | Voytas et al. |
| 2013/0137138 | A1 | 5/2013 | Hansen |
| 2014/0329281 | A1 | 11/2014 | Houghton-Larsen et al. |
| 2015/0159188 | A1 | 6/2015 | Ono et al. |
| 2015/0342234 | A1 | 12/2015 | Hicks et al. |

FOREIGN PATENT DOCUMENTS

| | | |
|---|---|---|
| CN | 103397064 | 11/2013 |
| EP | 0955363 | 11/1999 |
| EP | 1072683 | 1/2001 |
| EP | 1171610 | 4/2007 |
| EP | 1198575 | 9/2007 |
| EP | 1383864 | 1/2008 |
| EP | 1897951 | 3/2008 |
| EP | 1947189 | 7/2008 |
| EP | 1392824 | 8/2008 |
| EP | 2902410 | 8/2015 |
| JP | 5910-001408 | 6/1984 |
| JP | 3-277275 | 12/1991 |
| JP | 05-115298 | 5/1993 |
| JP | 2009034080 | 2/2009 |
| KR | 20150000258 | 1/2015 |
| WO | WO 1999/018224 | 4/1999 |
| WO | WO 2000/036081 | 6/2000 |
| WO | WO 2000/037663 | 6/2000 |
| WO | WO 2000/063400 | 10/2000 |
| WO | WO 2001/012828 | 2/2001 |
| WO | WO 2013/022989 | 2/2001 |
| WO | WO 2001/083769 | 11/2001 |
| WO | WO 2001/094561 | 12/2001 |
| WO | 2002/024865 | 3/2002 |
| WO | WO 2002/020728 | 3/2002 |
| WO | WO 2002/020815 | 3/2002 |
| WO | WO 2002/055709 | 7/2002 |
| WO | WO 2003/008540 | 1/2003 |
| WO | WO 2004/029255 | 4/2004 |
| WO | WO 2005/079183 | 9/2005 |
| WO | WO 2006/016395 | 2/2006 |
| WO | WO 2006/093289 | 9/2006 |
| WO | WO 2006/096392 | 9/2006 |
| WO | WO 2007/136847 | 11/2007 |
| WO | WO 2008/008256 | 1/2008 |
| WO | WO 2008/034648 | 3/2008 |
| WO | WO 2008/039499 | 4/2008 |
| WO | WO 2008/051349 | 5/2008 |
| WO | WO 2008/091547 | 7/2008 |
| WO | WO 2009/005704 | 1/2009 |
| WO | WO 2009/071277 | 6/2009 |
| WO | WO 2009/086049 | 7/2009 |
| WO | WO 2009/105612 | 8/2009 |
| WO | WO 2009/108680 | 9/2009 |
| WO | 2009/140394 | 11/2009 |
| WO | WO 2009/140394 | 11/2009 |
| WO | WO 2010/021001 | 2/2010 |
| WO | WO 2010/038911 | 4/2010 |
| WO | 2010/142305 | 12/2010 |
| WO | WO 2010/146463 | 12/2010 |
| WO | WO 2011/028671 | 3/2011 |
| WO | WO 2011/037959 | 3/2011 |
| WO | WO 2011/046423 | 4/2011 |
| WO | WO 2011/056834 | 5/2011 |
| WO | WO 2011/153378 | 8/2011 |
| WO | 2011/140329 | 11/2011 |
| WO | 2011/151326 | 12/2011 |
| WO | 2011/153378 | 12/2011 |
| WO | WO 2011/151326 | 12/2011 |
| WO | WO 2011/153144 | 12/2011 |
| WO | WO 2012/075030 | 6/2012 |
| WO | 2013/022989 | 2/2013 |
| WO | WO 2013/019050 | 2/2013 |
| WO | WO 2013/076577 | 5/2013 |
| WO | WO 2013/096420 | 6/2013 |
| WO | WO 2013/110673 | 8/2013 |
| WO | WO 2013/110673 | 9/2013 |
| WO | WO 2013/176738 | 11/2013 |
| WO | WO 2014/086890 | 6/2014 |
| WO | WO 2014/122227 | 8/2014 |
| WO | WO 2014/122328 | 8/2014 |
| WO | 2014/191580 | 12/2014 |
| WO | 2014/191581 | 12/2014 |
| WO | 2015/011209 | 1/2015 |
| WO | 2015/014959 | 2/2015 |
| WO | 2015/016393 | 2/2015 |
| WO | WO 2015/014969 | 2/2015 |
| WO | 2016/023844 | 2/2016 |
| WO | WO 2016/038095 | 3/2016 |
| WO | 2017/025362 | 2/2017 |

OTHER PUBLICATIONS

Chen et al., "Sugar transporters for intercellular exchange and nutrition of pathogens," Nature 468(7323):527-32 (2010).
Chen et al., "Fusion protein linkers: Property, design, and functionality", Advanced Drug Delivery reviews, 65(0):1257-69 (2013).
Daran et al., "Genetic and biochemical characterization of the UGP1 gene encoding the UDP-glucose pyrophosphorylase from *Saccharomyces cerevisiae*," Eur J Biochem. 233(2):520-30 (1995).
Gloster, "Advances in understanding glycosyltransferases from a structural perspective," Curr Opin Struct Biol. 28:131-41 (2014).
Guo et al., "Protein tolerance to random amino acid change", Proceedings of the National Academy of Sciences USA, vol. 101, No. 25, pp. 9205-9210 (2004).
Husar et al., Overexpression of the UGT73C6 alters brassinosteriod glucoside formation in *Arabidopsis thaliana*, BMC Plant Biology, 11:1-14 (2011).
Liu et al., "Biosynthesis of Rebaudioside A by Whole Cell of Recombinant *Saccharomyces cerevisiae*," Food and Fermentation Industries, 38(7): 6-10 (2012) (Abstract translation).
Nagatoshi et al., "UGT75L6 and UGT94E5 mediate sequential glucosylation of crocetin to crocin in Gardenia iasminoides", FEBS Letters, 586:1055-1061 (2012).
Ni et al., "Outer membrane mutation effects on UDP-glucose permeability and whole-cell catalysis rate," Appl Microbiol Biotechnol. 73(2):384-93 (2006).
Prisic et al, "Synergistic substrate inhibition of ent-copalyl diphosphate synthase: a potential feed-forward inhibition mechanism limiting gibberellin metabolism," Plant Physiol. 144(1):445-54 (2007).
Ünligil et al., "Glycosyltransferase structure and mechanism," Curr Opin Struct Biol. 10(5):510-7 (2000).

(56) References Cited

OTHER PUBLICATIONS

Wanchao et al., "Advances on the Stevoil Glycoside Biosynthesis and Its Key Enzymes," Biotechnology Bulletin, Feb. 2008 (English Abstract Translation).
Wang et al., "Design and construction of artificial biological systems for complex natural products biosynthesis," Chinese Journal of Biotechnology, 29(8):1146-60 (2013).
Yang et al., Base substitution mutations in uridinediphosphate-dependent glycosyltransferase 76G1 gene of Stevia rebaudiana causes the low levels of rebaudioside A: mutations in UGT76G1, a key gene of steviol glycosides synthesis, Plant Physiol Biochem. 80:220-5 (2014).
GenBank Accession No. AAS07253.1, dated Jan. 31, 2004 (3 pages).
GenBank Accession No. XM_001467423, dated Jul. 16, 2015 (2 pages).
GenBank Accession No. XP_002282091, dated Dec. 7, 2011 (1 page).
GenBank Accession No. XP_002288339, dated Jul. 15, 2009 (2 pages).
GenBank Accession No. XP_002311286, dated Dec. 31, 2013 (2 pages).
GenBank Accession No. ZP_05004570, dated Jun. 8, 2010 (2 pages).
Gossen & Bujard, "Studying gene function in eukaryotes by conditional gene inactivation," Annu. Rev. Genet. 36:153-73 (Jun. 2002).
Gritz & Davies, "Plasmid-encoded hygromycin B resistance: the sequence of hygromycin B phosphotransferase gene and its expression in *Escherichia coli* and *Saccharomyces cerevisiae*," Gene 25(2-3):179-88 (Nov. 1983).
Hallstrom & Moye-Rowley, "Divergent transcriptional control of multidrug resistance genes in *Saccharomyces cerevisiae*," J. Biol. Chem. 273(4):2098-104 (Jan. 1998).
Katzmann et al., "Expression of an ATP-binding cassette transporter-encoding gene (YOR1) is required for oligomycin resistance in *Saccharomyces cerevisiae*," Mol. Cell Biol. 15(12):6875-83 (Dec. 1995).
Li et al., "Phylogenetic analysis of the UDP-glycosyltransferase multigene family of *Arabidopsis thaliana*," J. Biol. Chem. 276(6):4338-43 (Oct. 2000).
Masada et al., "An efficient chemoenzymatic production of small molecule glucosides with in situ UDP-glucose recycling," FEBS Lett. 581(13):2562-6 (May 2007).
Morita et al., "Japanese morning glory dusky mutants displaying reddish-brown or purplish-gray flowers are deficient in a novel glycosylation enzyme for anthocyanin biosynthesis, UDP-glucose:anthocyanidin 3-O-glucoside-2"-O-glucosyltransferase, due to 4-bp insertions in the gene," Plant J. 42(3):353-63 (May 2005).
Nagy et al., "Role of the yeast ABC transporter Yor1p in cadmium detoxification," Biochimie 88(11):1665-71 (Jun. 2006).
Nikaido & Takatsuk, "Mechanisms of RND multidrug efflux pumps," Biochim. Biophys. Acta. 1794(5):769-81 (May 2009).
Osmani et al., "Catalytic key amino acids and UDP-sugar donor specificity of a plant glucuronosyltransferase, UGT94B1: molecular modeling substantiated by site-specific mutagenesis and biochemical analyses," Plant Physiol. 148(3):1295-308 (Nov. 2008).
Osmani et al., "Substrate specificity of plant UDP-dependent glycosyltransferases predicted from crystal structures and homology modeling," Phytochemistry 70(3):325-47 (Feb. 2009).
Richman et al., "Functional genomics uncovers three glucosyltransferases involved in the synthesis of the major sweet glucosides of Stevia rebaudiana," Plant J. 41(1):56-67 (Jan. 2005).
Riesmeier et al., "Isolation and characterization of a sucrose carrier cDNA from spinach by functional expression in yeast," EMBO J. 11(13):4705-13 (Dec. 1992).
Rodríguez-Concepción & Boronat, "Elucidation of the methylerythritol phosphate pathway for isoprenoid biosynthesis in bacteria and plastids. A metabolic milestone achieved through genomics," Plant Physiol. 130(3):1079-89 (Nov. 2002).

Saier JR et al., "The major facilitator superfamily," J. Mol. Microbiol. Biotechnol. 1(2):257-79 (Nov. 1999).
Saier JR et al., "The Transporter Classification Database: recent advances," Nucleic Acids Res. 37:D274-8 (Jan. 2009).
Sauer et al., "The soluble and membrane-bound transhydrogenases UdhA and PntAB have divergent functions in NADPH metabolism of *Escherichia coil*," J. Biol. Chem. 279(8):6613-9 (Dec. 2003).
Sawada et al., "UDP-glucuronic acid:anthocyanin glucuronosyltransferase from red daisy (*Bellis perennis*) flowers. Enzymology and phylogenetics of a novel glucuronosyltransferase involved in flower pigment biosynthesis," J. Biol. Chem. 280(2):899-906 (Jan. 2005).
Shao et al., "Enhanced production of alpha-galactosyl epitopes by metabolically engineered Pichia pastoris," Appl. Environ. Microbiol. 69(9):5238-42 (Sep. 2003).
Son et al., "Production of flavonoid O-glucoside using sucrose synthase and flavonoid O-glucosyltransferase fusion protein," J. Microbiol. Biotechnol. 19(7):709-12 (Jul. 2009).
Sonnhammer et al., "Pfam: a comprehensive database of protein domain families based on seed alignments," Proteins 28(3):405-20 (Jul. 1997).
Sonnhammer et al., "Pfam: multiple sequence alignments and HMM-profiles of protein domains," Nucleic Acids Res. 26(1):320-2 (Jan. 1998).
Yadav et al., "Steviol Glycosides from Stevia: Biosynthesis Pathway Review and their Application in Foods and Medicine", Critical Reviews in Food Science and Nutrition, vol. 52, No. 11, pp. 988-998; (2012).
International Search Report by the International Searching Authority for International Application No. PCT/EP2014/052675, dated Apr. 23, 2014 (5 pages).
Written Opinion of the International Searching Authority for International Application No. PCT/EP2014/052675, dated Apr. 23, 2014 (7 pages).
Non-Final Office Action for U.S. Appl. No. 14/648,747, dated Mar. 23, 2017 (pp. 1-20).
International Preliminary Report on Patentability from the International Bureau for International Application No. PCT/EP2015/068314, dated Feb. 14, 2017 (pp. 1-10).
International Search Report and Written Opinion of the International Searching Authority for International Application No. PCT/EP2016/080516; dated Mar. 15, 2017, pp. 1-22.
Boer, "Strain and process development for fermentative production of Rebaudiosides" Abstract of Offered Oral from 33rd International Specialised Symposium on Yeasts; Jun. 26-29, 2017 University of College Cork, Ireland; pp. 1-2.
Garber et al., "Computational methods for transcriptome annotation and quantification using RNA-seq," Nat Methods 8(6):469-77 (2011).
Kawai et al., "Transformation of *Saccharomyces cerevisiae* and other fungi: methods and possible underlying mechanism," Bioeng Bugs. 1(6):395-403 (2010).
Lin et al., "Arrestin-related ubiquitin-ligase adaptors regulate endocytosis and protein turnover at the cell surface," Cell 135(4):714-25 (2008).
Mahe et al., "The ATP Binding Cassette Transporters Pdr5 and Snq2 of *Saccharomyces cerevisiae* Can Mediate Transport of Steriods via in Vivo", JBC, 271(41):25167-25172. (Oct. 1996).
Malonek et al., "The NADPH-cytochrome P450 Reductase Gene from Gibberalla fujikuroi is Essential for Gibberellin Biosynthesis," J Bio Chem. 279(24):25075-84 (2004).
Nagalakshmi et al., "The transcriptional landscape of the yeast genome defined by RNA sequencing," Science 320(5881): 1344-9 (2008).
Nikko et al. "Arrestin-like proteins mediate ubiquitination and endocytosis of the yeast metal transporter Smf1," EMBO Rep. 9(12):1216-21 (2008).
Nikko & Pelham, "Arrestin-mediated endocytosis of yeast plasma membrane transporters," Traffic 10(12):1856-67 (2009).
Ohta et al., MassBank Accession No. FU000299 (May 2016).
Ohta et al., MassBank Accession No. FU000332 (May 2016).
Olsson et al., "Microbial production of next-generation stevia sweeteners," Microbial Cell Factories, 15:11-14 (2016).

(56) References Cited

OTHER PUBLICATIONS

Partow et al., "Characterization of different promoters for designing a new expression vector in *Saccharomyces cerevisiae*," Yeast 27:955-64 (2010).
Robinson & Oshlack et al., "A scaling normalization method for differential expression analysis of RNA-seq data," Genome Biol. 11(3):R25 (2010).
Saier Jr. et al., "The transporter classification database," Nucl. Acids Res., 42(1):D251-258 (2014).
Song et al., "The Aspergillus fumigatus 1-29 damage resistance protein family coordinately regulates ergosterol biosynthesis and azole susceptibility," MBIO, 7:1-13 (2016).
Starratt et al., "Rebaudioside F, a diterpene glycoside from Stevia redaudiana", Phytochemistry, 59(4):367-370. (Feb. 2002). Abstract.
Wang et al., "RNA-Seq: a revolutionary tool for transcriptomics," Nat Rev Genet. 10(1):57-63 (2009).
Wilhelm et al., "Defining transcribed regions using RNA-seq," Nature Protocols 5:255-66 (2010).
Yang Quanhua et.al., "Analysis of the Chemical constituents of Stevia rebaudiana and its sweetness," Journal of Beijing University of Chemical Technology, vol. 39, No. 2., p. 28-32 (2012) (English Abstract).
Non-Final Office Action for U.S. Appl. No. 14/761,629, dated Mar. 21, 2017 (pp. 1-19).
Final Office Action for U.S. Appl. No. 14/761,629, dated Aug. 11, 2017 (pp. 1-16).
Third Party Observation in EP Application No. 13801569.8; dated Apr. 26, 2017. pp. 1-5.
International Search Report and Written Opinion of International Search Authority for International Application No. PCTEP2017/059028; dated Jun. 27, 2017, pp. 1-15.
Non-Final Office Action for U.S. Appl. No. 14/764,898, dated Mar. 30, 2017, pp. 1-17.
Uniprot Accession No. P53320, dated Feb. 17, 2016 (pp. 1-10).
Uniprot Accession No. P38735, dated Feb. 17, 2016 (pp. 1-13).
Uniprot Accession No. P38734, dated Feb. 17, 2016 (pp. 1-10).
Uniprot Accession No. P38702, dated Feb. 17, 2016 (pp. 1-9).
Uniprot Accession No. P38695, dated Feb. 17, 2016 (pp. 1-11).
Uniprot Accession No. P40556, dated Feb. 17, 2016 (pp. 1-10).
Uniprot Accession No. P40475, dated Feb. 17, 2016 (pp. 1-9).
Uniprot Accession No. P40474, dated Jan. 20, 2016 (pp. 1-11).
Uniprot Accession No. P40445, dated Dec. 9, 2015 (pp. 1-9).
Uniprot Accession No. P10566, dated Feb. 17, 2016 (pp. 1-10).
Uniprot Accession No. P40885, dated Feb. 17, 2016 (pp. 1-11).
Uniprot Accession No. P30902, dated Nov. 11, 2015 (pp. 1-9).
Uniprot Accession No. P35736, dated Jan. 20, 2016 (pp. 1-8).
Uniprot Accession No. P32332, dated Feb. 17, 2016 (pp. 1-10).
Uniprot Accession No. P36062, dated Jan. 20, 2016 (pp. 1-10).
Uniprot Accession No. P12866, dated Jan. 20, 2016 (pp. 1-14).
Uniprot Accession No. P19145, dated Feb. 17, 2016 (pp. 1-12).
Uniprot Accession No. Q06686, dated Nov. 11, 2015 (pp. 1-9).
Uniprot Accession No. Q03697, dated Feb. 17, 2016 (pp. 1-10).
Uniprot Accession No. Q03829, dated Feb. 17, 2016 (pp. 1-9).
Uniprot Accession No. Q03263, dated Feb. 17, 2016 (pp. 1-10).
Uniprot Accession No. P38921, dated Feb. 17, 2016 (pp. 1-10).
Uniprot Accession No. P32487, dated Feb. 17, 2016 (pp. 1-12).
Uniprot Accession No. P53389, dated Feb. 17, 2016 (pp. 1-10).
Uniprot Accession No. Q08299, dated Feb. 17, 2016 (pp. 1-10).
Uniprot Accession No. Q12289, dated Feb. 17, 2016 (pp. 1-10).
Uniprot Accession No. P33302, dated Feb. 17, 2016 (pp. 1-23).
Uniprot Accession No. Q12029, dated Jan. 20, 2016 (pp. 1-9).
Uniprot Accession No. Q12256, dated Feb. 17, 2016 (pp. 1-12).
Uniprot Accession No. P22215, dated Feb. 17, 2016 (pp. 1-11).
Uniprot Accession No. P22203, dated Jan. 20, 2016 (pp. 1-10).
Uniprot Accession No. P15380, dated Feb. 17, 2016 (pp. 1-11).
Uniprot Accession No. P19657, dated Feb. 17, 2016 (pp. 1-12).
Liu et al., "Functional and Biochemical Characteritzation of *Escherichia coli* Sugar Efflux Transporters," JBC, 274(33):22977-22984 (Aug. 1999).
Sun et al., "Regulation and Function of *Escherichia coli* Sugar Efflux Transporter A (Set A) during Glucose-Phosphate Stress," J of Bacteriology, 193(1):143-153 (Jan. 2011).
International Search Report and Written Opinion of the International Searching Authority for International Application No. PCT/EP2016/068259; dated Jan. 24, 2017, pp. 1-18.
Shao et al., "Crystal structures of a multifunctional triterpene/flavonoid glycosyltransferase from Medicago truncatula," Plant Cell 17(11):3141-54 (2005).
Shibata et al., "Glucosylation of Steviol and Steviol-Glucosides in Extracts from Stevia rebaudiana Bertoni" Plant Physiol. 95(1):152-56 (1991).
Singh et al., "Compendium of Transgenic Crop Plants: Transgenic Sugar, Tuber and Fiber," Ed. Kole & Hall, Blackwell Publishing Ltd. pp. 97-115 (2008).
U.S. Food and Drug Administration GRAS Notice 323, "GRAS Assessment of High Purity Steviol Glycosides; Food Usage Conditions for General Recognition of Safety for PureCircle USA, Inc.," pp. 1-262 (Feb. 2010).
U.S Food and Drug Administration GRAS Notice Notice 329, "Notice to the U.S. Food and Drug Administration that the use of RebpureTM (Rebaudioside A) derived from Stevia rebaudiana, as a Food Ingredient is Generally Recognized as Safe (GRAS)," pp. 1-275 (Mar. 2010).
Van Ooyen et al., "Heterologous protein production in the yeast *Kluyveromyces lactis*," FEMS Yeast Res. 6 (3):381-92 (May 2006).
Vazquez De Aldana et al., "Nucleotide sequence of the exo-1,3-beta-glucanase-encoding gene, EXG1, of the yeast *Saccharomyces cerevisiae*," Gene 97(2):173-82 (1991).
Verwaal et al., "High-Level Production of Beta-Carotene in *Saccharomyces cerevisiae* by Successive Transformation with Carotenogenic Genes from Xanthophyllomyces dendrorhous," Appl Environ Microbiol. 73(13):4342-50 (2007).
Wallin, "Steviol Glycosides," Chem. Tech Assessment—63rd JECFA, pp. 1-5 (2004).
Wallin, "Steviol Glycosides," Chem. Tech Assessment—69th JECFA, pp. 1-7 (2007).
Wallner & Elofsson, "Can correct protein models be identified?," Protein Sci. 12(5):1073-86 (May 2003).
Wang, "Structure, mechanism and engineering of plant natural product glycosyltransferases," FEBS Letters 583(20):3303-9 (2009).
Xu et al., "Generation of hepatitis B virus PreS2-S antigen in Hansenula polymorpha," Virol Sin. 29(6):403-9 (Dec. 2014).
Yadav et al., "A review on the improvement of stevia [*Stevia rebaudiana* (Bertoni)]," Can J Plant Sci. 91:1-27 (2011).
Yao et al., "A genetic linkage map for Stevia rebaudiana," Genome 42:657-61 (1999).
Yazaki, "ABC transporters involved in the transport of plant secondary metabolites," FEBS Lett. 580(4):1183-91 (Feb. 2006).
Yu et al., "Bioconversion of ethyl 4-chloro-3-oxobutanoate by permeabilized fresh brewer's yeast cells in the presence of allyl bromide," J Ind Microbiol Biotechnol. 34(2)151-6 (2007).
Yuan et al., "Kinetics and activation parameters for oxidations of styrene by Compounds I from the cytochrome P450 (BM-3) (CYP102A1) heme domain and from CYP119," Biochemistry 48(38):9140-6 (Sep. 2009).
Zheng et al. "An efficient one-step site-directed and site-saturation mutagenesis protocol," Nucleic Acids Res. 32(14):e115 (Aug. 2004).
Zhu et al., "A multi-omic map of the lipid-producing yeast *Rhodosporidium toruloides*," Nature Commun. 3:1112 (Oct. 2012).
GenBank Accession No. AAF61439.1, dated Sep. 25, 2000 (2 pages).
GenBank Accession No. AAM53963.1, dated Jun. 17, 2002 (2 pages).
GenBank Accession No. AAR06918.1, dated Dec. 28, 2004 (2 pages).
GenBank Accession No. AAT93110.1, dated Apr. 24, 2007 (2 page).
GenBank Accession No. ACE87855.1, dated Jun. 24, 2008 (1 page).
GenBank Accession No. ACM47734.1, dated Feb. 7, 2009 (1 page).
GenBank Accession No. ACT33422.1, dated Jul. 17, 2009 (1 page).
GenBank Accession No. AF515727.1, dated Jun. 17, 2002 (2 pages).

(56) References Cited

OTHER PUBLICATIONS

GenBank Accession No. AY345974.1, dated Dec. 28, 2004 (2 pages).
GenBank Accession No. AY345978.1, dated Dec. 28, 2004 (2 pages).
Genbank Accession No. AY345980.1, dated Dec. 28, 2004 (2 pages).
SenBank Accession No. AY345982.1, dated Dec. 28, 2004 (2 pages).
GenBank Accession No. BG521726.1, dated May 13, 2000 (2 pages).
GenBank Accession No. CAA23011.1, dated Oct. 23, 2008 (2 pages).
GenBank Accession No. CAA46815.1, dated Apr. 18, 2005 (2 pages).
GenBank Accession No. DQ269454A, dated May 28, 2008 (2 pages).
GenBank Accession No. EU722415.1, dated Jun. 10, 2008 (2 pages).
GenBank Accession No. EU751291.1, dated Jun. 24, 2008 (2 pages).
EBI Accession No. AAY05902, "Jerusalem artichoke in-chain hydroxylase CYP8161" (1 page).
EBI Accession No. ABM86477, "Rice abiotic stress responsive polypeptide SEQ ID No. 4723" (1 page).
UniProt Accession No. F2DG34, May 2011 (pp. 1-4).
UniProt Accession No. Q6VAA8, 2004 (pp. 1-6).
UniProt Accession No. Q7FPQ4, 2004 (pp. 1-6).
Jewett et al. "An integrated cell-free metabolic platform for protein production and synthetic biology," Mol Syst Biol. 4:220 (2008).
Johnstone et al., "Cloning an Aspergillus nidulans developmental gene by transformation," EMBO J. 4(5):1307-11 (1985).
Khoury et al., "Computational design of Candida boidinii xylose reductase for altered cofactor specificity," Protein Sci. 18(10):2125-38 (Oct. 2009).
Kim et al., "Hydroxylation of ent-Kaurenoic Acid to Steviol in Stevia rebaudiana Bertoni-Purification and Partial Characterization of the Enzyme," Arch Biochem Biophys. 332(2):223-30 (1996).
Kim & Shibata, "Characterization of ent-kaurenoic acid 13-hydroxylase in steviol biosynthesis of Stevia rebaudiana Bertoni," Journal of the Korean Agriculturalchemical Society 40(6):501-7 (1997).
Knowles et al., "Genetic Transformation and Plant Regeneration in Stevia rebaudiana Using Microprojectile Bombardment," In Vitro Cellular & Developmental Biology 39(abstract):23-A (2003).
Kohda et al., "New Sweet Diterpene glucoside from Stevia Rebaudiana," Phytochemistry 15(6):981-3 (1976).
Kondo et al., "Preparation of high activity whole cell biocatalyst by permeabilization of recombinant flocculent yeast with alcohol," Enzyme Microb Technol. 27(10),806-11 (2000).
"Kumar et al., ""A comprehensive analysis of fifteen genes of steviol glycosides biosynthesis pathwayin Stevia rebaudiana (Bertoni)""" Gene 492:276-84 (Epub 20 Oct. 2011)."
Kusama et al., "Transglucosylation into stevioside by the enzyme system from Streptomyces sp.," Agric. Biol. Chem. 50(10):2445-51 (Oct. 1986).
Li et al., "Crystal structure of Medicago truncatula UGT85H2—insights into the structural basis of a multifunctional (iso) flavonoid glycosyltransferase," J Mol Biol. 370(5):951-63 (2007).
Li et al., "Systematic Mutational Analysis of Peptide Inhibition of the p53-MDM2/MDMX," J Mol Biol. 398(2):200-13 (2010).
Li et al., "High-density cultivation of oleaginous yeast Rhodosporidium toruloides Y4 in fed-batch culture," Enzyme and Microbial Technology 41(3):312-7 (Aug. 2007).
Liu et al., "Preparation of high-activity whole cell biocatalysts by permeabilization of recombinant yeasts with alcohol," J Biosci Bioeng. 89(6):554-8 (2000).
Ma et al., "Molecular cloning and characterization of Stevia Rebaudiana UDP-glucosyltransferase," Acta Biologiae Experimentalis Sinica 36(2):123-9 (2003).
Ma "Part 1. Molecular Cloning and Functional Analysis of UDPG Glucosyltransferase Gene. Part 2. Molecular Cloning, Sequence Analysis and Evolution of Actin and EF1a Genes in Stevia Rebaudiana." Chinese Doctor and Master Dissertations Full-Text Database, Agricultural Technology Part, vol. 2; pp. 1-74 (2004).
Madan et al., "Stevia rebaudiana (Bert.) Bertoni—A Review," Indian Journal of Natural Products and Resources 1(3):267-86 (2010).
Madhav et al., "Functional and structural variation of uridine diphosphate glycosyltransferase (UGT) gene of Stevia rebaudiana—UGTSr involved in the synthesis of rebaudioside A," Plant Physiol. Biochem. 63:245-53 (Feb. 2013).
Mantovaneli et al., "The effect of temperature and flow rate on the clarification of the aqueous stevia-extract in a fixed-bed column with zeolites," Braz J Chem Eng. 21(3):449-58 (2004).
Mattanovich et al., "Recombinant protein production in yeasts," Methods Mol Biol. 824:329-58 (2012).
Megeji et al., "Introducing Stevia rebaudiana, a natural zero-calorie sweetener," Current Science 88(5):801-4 (2005).
Mohamed et al., "UDP-dependent glycosyltransferases involved in the biosynthesis of steviol glycosides" Journal of Plant Physiology 168(10):1136-1141 (Jul. 2011; Epub Apr. 7, 2011).
Mumberg et al., "Yeast vectors for the controlled expression of heterologous proteins in different genetic backgrounds," Gene 156(1):119-22 (1995).
Naesby et al., "Yeast artificial chromosomes employed for random assembly of biosynthetic pathways and production of diverse compounds in Saccharomyces cerevisiae," Microb Cell Fact. 8:45 (2009).
Naglak & Wang, "Rapid protein release from Escherichia coli by chemical permeabilization under fermentation conditions," Biotechnol Bioeng. 39(7):732-40 (1991).
Nakagiri et al., "cDNA cloning, functional expression and characterization of ent-copalyl diphosphate synthase from Scoparia dulcis L.," Plant Sci. 169:760-7 (2005).
Nelson et al., "P450 superfamily: update on new sequences, gene mapping, accession numbers and nomenclature," Pharmacogenetics 6:1-42 (1996).
Newman et al., "High-level production of amorpha-4,11-diene in a two-phase partitioning bioreactor of metabolically engineered Escherichia coli," Biotechnol Bioeng 95(4):684-91 (2006).
Nicaud, "Yarrowia lipolytica," Yeast 29(10):409-18 (Oct. 2012).
Nielsen et al., "Efficient PCR-based gene targeting with a recyclable marker for Aspergillus nidulans," Fungal Genet Biol. 43(1):54-64 (2006).
Nour-Eldin et al., "USER cloning and USER fusion: the ideal cloning techniques for small and big laboratories," Methods Mol Biol. 643:185-200 (2010).
Ohta et al., "Characterization of Novel Steviol Glycosides from Leaves of Stevia rebaudiana Morita," J. Applied Glycosides 57(3):199-209 (Mar. 2010).
Ohta et al., MassBank Accession No. FU000341 (May 2011).
Ohta et al., MassBank Accession No. FU000342 (May 2011).
Ohta et al., MassBank Accession No. FU000343 (May 2011).
Ohtani et al., "Further Study on the 1,4-alpha-Transglucosylation of Rubusoside, a Sweet Steviol-Bisglucoside from Rubus suavissimus," Agric Biol Chem. 55(2):449-53 (1991).
Oka & Jigami, "Reconstruction of de novo pathway for synthesis of UDP-glucuronic acid and UDP-xylose from Intrinsic UDP-glucose in Saccharomyces cerevisiae," FEBS J. 273(12):2645-57 (2006).
Orihara et al., "Biotransformation of steviol by cultured cells of eucalyptus perriniana and Coffea Arabica," Phytochemistry 30(12):3989-92 (1991).
Paradise et al., "Redirection of flux through the FPP branch-point in Saccharomyces cerevisiae by down-regulating squalene synthase," Biotechnol Bioeng. 100(2):371-8 (2008).
Pearson & Lipman, "Improved tools for biological sequence comparison," Proc Natl Acad Sci. 85(8):2444-8 (1998).
Piirainen et al., "Glycoengineering of yeasts from the perspective of glycosylation efficiency," N Biotechnol. 31(6):532-7 (Dec. 2014).
Pompon et al., "Yeast Expression of Animal and Plant P450s in Optimized RedoxEnvironments," Methods Enzymol 272:51-64 (1996).

(56) References Cited

OTHER PUBLICATIONS

Prelich, "Gene overexpression: uses, mechanisms, and interpretation," Genetics 190(3):841-54 (Mar. 2012).
Presecki & Vasic-Racki, "Production of L-malic acid by permeabilized cells of commercial *Saccharomyces* sp. strains," Biotechnol Lett. 27(23-24):1835-9 (2005).
Ro et al., "Production of the antimalarial drug precursor artemisinic acid in engineered yeast," Nature 440(7086):940-3 (2006).
Saenge et al., "Potential use of oleaginous red yeast *Rhodotorula glutinis* for the bioconversion of crude glycerol from biodiesel plant to lipids and carotenoids," Process Biochemistry 46(1):210-8 (Jan. 2011).
Schwab et al., Poster, "Watchmaker®—Compound Generation by Combinatorial Genetics and Screening in Yeast," 141st Annual Conference in St. Louis, 2008, 1 page.
Sen et al., "Developments in Directed Evolution for Improving Enzyme Functions," Appl Biochem Biotechnol.143(3):212-23 (2007).
Senthilraja et al., "RNA secondary structure prediction: Analysis of *Saccharomyces cerevisiae* RNAs," Int. J. Pharm. Rev. Res. 25(2):287-91 (Mar.-Apr. 2014).
International Search Report issued by the International Searching Authority for International Application No. PCT/US2011/038967, dated Sep. 1, 2011 (10 pages).
Written Opinion of the International Searching Authority for International Application No. PCT/US2011/038967, dated Sep. 1, 2011 (12 pages).
International Preliminary Report on Patentability issued by the International Bureau for International Application No. PCT/US2011/038967, dated Dec. 4, 2012 (13 pages).
Third-Party Submission under 37 CFR 1.290 for U.S. Appl. No. 13/701,406, dated Mar. 22, 2013 (238 pages).
Extended European Search Report and Opinion issued by the European Patent Office for European Application No. 11790428.4, dated Dec. 20, 2013.
Search Report issued by the Intellectual Property Office of Singapore for Singaporean Application No. 201208854-8, dated Nov. 3, 2014.
Non-Final Office Action for U.S. Appl. No. 14/237,540, dated Dec. 30, 2015 (pp. 1-19).
Final Office Action issued in U.S. Appl. No. 14/237,540; dated Jul. 8, 2016, pp. 1-19.
International Search Report issued by the International Searching Authority for International Application No. PCT/US2012/050021, dated Apr. 12, 2013.
Written Opinion of the International Searching Authority for International Application No. PCT/US2012/050021, dated Apr. 12, 2013.
International Preliminary Report on Patentability issued by the International Bureau for International Application No. PCT/US2012/050021, dated Feb. 11, 2014.
Extended European Search Report issued in EP 15193074.0; dated Feb. 12, 2016, pp. 1-9.
International Search Report from the International Searching Authority for International Application No. PCT/EP2014/052363, dated Sep. 22, 2014 (12 pages).
Written Opinion of the International Searching Authority for International Application No. PCT/EP2014/052363, dated Sep. 22, 2014 (10 pages).
International Preliminary Report on Patentability issued by the International Bureau for International Application No. PCT/EP2014/052363, dated Aug. 11, 2015. (11 pages).
International Preliminary Report on Patentability issued by the International Bureau for International Application No. PCT/EP2014/052675, dated Aug. 11, 2015 (8 pages).
International Search Report of the International Searching Authority for International Application No. PCT/EP2013/075587, dated Feb. 20, 2014 (pp. 1-5).
Written Opinion of the International Searching Authority for International Application No. PCT/EP2013/075587, dated Feb. 20, 2014 (pp. 1-9).
International Preliminary Report on Patentability from the International Bureau for International Application No. PCT/EP2013/075587, dated Jun. 9, 2015 (pp. 1-10).
Third Party Submission in U.S. Appl. No. 14/648,747; dated Mar. 28, 2016, pp. 1-231.
Invitation to Pay Additional Fees and, Where Applicable, Protest Fee by the International Searching Authority for International Application No. PCT/EP2015/070620, dated Nov. 27, 2015 (pp. 1-14).
International Search Report by the International Searching Authority for International Application No. PCT/EP2015/070620; dated Mar. 29, 2016, pp. 1-10.
Written Opinion of the International Searching Authority for International Application No. PCT/EP2015/070620; dated Mar. 29, 2016, pp. 1-24.
International Search Report and Written Opinion of the International Searching Authority for International Application No. PCT/EP2015/068314, dated Jan. 20, 2016 (pp. 1-7).
Written Opinion of the International Searching Authority for International Application No. PCT/EP2015/068314, dated Jan. 20, 2016 (pp. 1-9).
International Search Report and Written Opinion of the International Searching Authority for International Application No. PCT/EP2015/052007; dated Jul. 4, 2016, pp. 1-24.
Abraham & Bhat, "Permeabilization of bakers yeast with N-lauroyl sarcosine," J Ind Microbial Biotechnol. 35(8):799-804 (2008).
Ageitos et al., "Oily yeasts as oleaginous cell factories," Appl Microbiol Biotechnol. 90(4):1219-27 (May 2011).
Agrawal, "NMR spectroscopy in the structural elucidation of oligosaccharides and glycosides," Phytochemistry 31(10):3307-30 (1992).
Ajikumar et al., "Terpenoids: opportunities for biosynthsis of natural product drugs using engineered microorganisms," Molecular Pharmaceuticals 5(2):167-90 (2008).
Alakomi et al., "Lactic acid permeabilizes gram-negative bacteria by disrupting the outer membrane," Appl Environ Microbiol. 66(5):2001-5 (2000).
Ali et al., "Biochemical investigation during different stages of in vitro propagation of Stevia rebaudiana," Pak J Bot. 42(4):2827-37 (2010).
Bankar et al., "Environmental and industrial applications of Yarrowia lipolytica," Appl Microbiol Biotechnol. 84(5):847-65 (Oct. 2009).
Baykov et al., "A malachite green procedure for orthophosphate determination and its use in alkaline phosphatase-based enzyme immunoassay," Anal Biochem. 171(2):266-70 (Jun. 1988).
Beopoulos et al., "Yarrowia lipolytica: A model and a tool to understand the mechanisms implicated in lipid accumulation," Biochimie 91(6):692-6 (Jun. 2009).
Brandle et al., "Leaf ESTs from Stevia rebaudiana: A Resource for Gene Discovery in Diterpene Synthesis," Plant Mol Biol. 50(4-5):613-22 (2002).
Brandle & Telmer, "Steviol glycoside biosynthesis," Phytochemistry 68(14):1855-63 (2007).
Brochado et al. "Improved vanillin production in baker's yeast through in silico design," Microb Cell Fact. 9:84-98 (2010).
Carretero-Paulet et al., "Expression and Molecular Analysis of the *Arabidopsis* DXR Gene Encoding 1-Deoxy-d-Xylulose 5-Phosphate Reductoisomerase, the First Committed Enzyme of the 2-C-Methyl-D-Erythritol 4-Phosphate Pathway," Plant Physiol. 129(4):1581-91 (2002).
Ceunen & Geuns, "Steviol glycosides: chemical diversity, metabolism, and function," J. Nat. Prod. 76(6):1201-28 (Jun. 2013).
Chemler et al., "Biosynthesis of isoprenoids, polyunsaturated fatty acids and flavonoids in *Saccharomyces cerevisiae*," Microb Cell Fact. 5:20 (2006).
Chen et al., "MolProbity: all-atom structure validation for macromolecular crystallography," Acta Crystallogr D Biol Crystallogr 66(Pt 1):12-21 (Jan. 2010).
Chica et al., "Semi-rational approaches to engineering enzyme activity: combining the benefits of directed evolution and rational design," Curr Opin Biotechnol.16(4):378-84 (2005).
Chow & Palecek, "Enzyme encapsulation in permeabilized *Saccharomyces cerevisiae* cells," Biotechnol Prog. 20(2):449-56 (2004).

(56) References Cited

OTHER PUBLICATIONS

Correa et al., "Genetic mapping of 1,3-beta-glucanase-encoding genes in *Saccharomyces cerevisiae*," Current Genet. 22(4):283-8 (1992).
Darise et al., "Enzymic Transglucosylation of Rubusoside and the Structure-Sweetness Relationship of Steviol-Bisglycosides," Agric. Biol. Chem. 48(10):2483-8 (Jan. 1984).
Davis et al., "MolProbity: all-atom contacts and structure validation for proteins and nucleic acids," Nucleic Acids Res. 35:W375-83 (Apr. 2007).
Del Sorbo et al., "Fungal transporters involved in efflux of natural toxic compounds and fungicides," Fungal. Genet. Biol. 30(1):1-15 (Jun. 2000).
Diener et al., "*Arabidopsis* ALF5, a multidrug efflux transporter gene family member, confers resistance to toxins," Plant Cell 13(7):1625-38 (Jul. 2001).
Dodhia et al., "Engineering human cytochrome P450 enzymes into catalytically self-sufficient chimeras using molecular Lego," J Biol Inorg Chem. 11(7):903-16 (Oct. 2006).
Dubey, et al., An overview of the non-mevalonate pathway for terpenoid biosynthesis in plants, J. Biosci. 28(5):637-46 (2003).
Dubois & Stephenson, "Diterpenoid sweeteners. Synthesis and sensory evaluation of stevioside analogues with improved organoleptic properties," J. Med. Chem. 28(1):93-8 (Jan. 1985).
EFSA Panel on Food Additives and Nutrient Sources added to Food (ANS), "Scientific Opinion on the safety of steviol glycosides for the proposed uses as a food additive," EFSA Journal 8(4):1537 (2010).
Eisenreich et al., "Biosynthesis of isoprenoids via the non-mevalonate pathway," Cell Mol Life Sci. 61(12):1401-6 (2004).
Emboss Needle results for Pairwise Sequence Alignment of UGT91D1 and UGT91D2; dated Apr. 4, 2016, 2 pages.
Emmerstorfer et al., "Over-expression of ICE2 stabilizes cytochrome P450 reductase in *Saccharomyces cerevisiae* and Pichia pastoris," Biotechnol J. 10(4):623-35 (Apr. 2015).
Estrada De Martin et al., "Ice2p is important for the distribution and structure of the cortical ER network in *Saccharomyces cerevisiae*," J Cell Sci. 118(Pt 1):65-77 (Oct. 2006).
Fernandez et al., "Activation of chitin synthetase in permeabilized cells of a *Saccharomyces cerevisiae* mutant lacking proteinase B," J Bacteriol. 152(3):1255-64 (1982).
Flores et al., "Permeabilization of yeast cells (*Kluyveromyces lactis*) with organic solvents," Enzyme Microb Technol. 16(4):340-6 (1994).
Fowler & Zabin, " Effects of Dimethylsulfoxide on the Lactose Operon in *Escherichia coli*," J Bacteriol. 92(2):353-7 (1966).
Freire, "Differential scanning calorimetry," Methods Mol Biol. 40:191-218 (1995).
Fukunaga et al., "Enzymatic transglucosylation products of stevioside: separation and sweetness-evaluation," Agric. Biol. Chem. 53(6):1603-7 (Jan. 1989).
Geuns, "Stevioside," Phytochemistry 64(5):913-21 (2003).
Gietz & Schiestl, "High-efficiency yeast transformation using the LiAc/SS carrier DNA/PEG method," Nat Protoc. 2(1):31-4 (2007).
Girvan et al., "Flavocytochrome P450 BM3 mutant W1046A is a NADH-dependent fatty acid hydroxylase: implications for the mechanism of electron transfer in the P450 BM3 dimer," Arch Biochem Biophys. 507(1):75-85 (Mar. 2011).
Goralczyk, "Compounds from Stevia for Improving and Maintaining Mental Performance," Stevia World Forum, Feb. 24-25, 2010, 17 pages.
Guleria & Yadav, "Insights into Steviol Glycoside Biosynthesis Pathway Enzymes Through Structural Homology Modeling," Am. J. Biochem. Molec. Biol. 3(1):1-19 (2013).
Gunel et al., "Metabolic Engineering for Production of Geranylgeranyl Pyrophosphate Synthase in Non-Carotenogenic Yeast *Schizosaccharomyces pombe*," Biotechnol. & Biotechnol. Eq. 20(3):76-82 (2006).
Hansen et al., "De novo biosynthesis of vanillin in fission yeast (*Schizosaccharomyces pombe*) and bakes yeast (*Saccharomyces cerevisiae*)", Appl Environ Microbiol. 75(9):2765-74 (2009).
Hansen et al., "Versatile Enzyme Expression and Characterization System for Aspergillus nidulans, with the Penicillium brevicompactum Polyketide Synthase Gene from the Mycophenolic Acid Gene Cluster as a Test Case," Appl Environ Microbiol. 77(9):3044-51 (2011).
Hellfritsch et al., "Human psychometric and taste receptor responses to steviol glycosides," J. Agric. Food Chem. 60(27):6782-93 (Jul. 2012).
Humphrey et al., "Spatial organisation of four enzymes from Stevia rebaudiana that are involved in steviol glycoside synthesis," Plant Mol Bio. 61(1-2):47-62 (2006).
Iandolino et al., "High-Quality RNA, cDNA, and Derived EST Libraries From Grapevine (*Vitis vinifera* L.)," Plant Mol Biol Reporter 22:269-78 (2004).
Irmler et al., "Indole alkaloid biosynthesis in Catharanthus roseus: new enzyme activities and identification of cytochrome P450 CYP72A1 as secologanin synthase," Plant J. 24(6):797-804 (2000).
Jennewein et al., "Taxol biosythesis: baxane 13 alpha-hydroxylase is a cytochrome P450-dependent monooxygenase," Proc Natl Acad Sci U S A 98(24):13595-600 (2001).
Bateman et al., "Pfam 3.1: 1313 multiple alignments and profile HMMs match the majority of proteins," Nucleic Acids Res. 27(1)260-2 (Jan. 1999).
Bay & Turner, "Diversity and evolution of the small multidrug resistance protein family," BMC Evol. Biol. 9:140 (Jun. 2009).
Brachmann et al., "Designer deletion strains derived from *Saccharomyces cerevisiae* S288C: a useful set of strains and plasmids for PCR-mediated gene disruption and other applications," Yeast 14:115-32 (1998).
Chen et al., "Transferring a biosynthetic cycle into a productive *Escherichia coli* strain: large-scale synthesis of galactosides," J. Am. Chem. Soc. 123(36):8866-7 (Sep. 2001).
Chenna et al., "Multiple sequence alignment with the Clustal series of programs," Nucleic Acids Res. 31(13):3497-500 (Jul. 2003).
GenBank Accession No. AAB62280, dated Jul. 2, 1997 (2 pages).
GenBank Accession No. AAB87091, dated Mar. 22, 2000 (2 pages).
GenBank Accession No. AAC28895.1, dated Aug. 6, 1998 (2 pages).
GenBank Accession No. AAC39505, dated Jul. 26, 1998 (1 page).
GenBank Accession No. AAD34294, dated Mar. 22, 2000 (2 pages).
GenBank Accession No. AAD34295, dated Mar. 22, 2000 (2 pages).
GenBank Accession No. AAD47596, dated Aug. 9, 1999 (2 pages).
GenBank Accession No. AAH69913, dated Jul. 15, 2006 (2 pages).
GenBank Accession No. AEE36246, dated Oct. 6, 2014 (3 pages).
GenBank Accession No. AAR06912, dated Dec. 28, 2004 (2 pages).
GenBank Accession No. AAR06916.1, dated Dec. 28, 2004 (2 pages).
GenBank Accession No. AAR06920.1, dated Dec. 28, 2004 (2 pages).
GenBank Accession No. ABA42921, dated Jun. 21, 2006 (1 page).
GenBank Accession No. ABB88839, dated May 28, 2008 (2 pages).
GenBank Accession No. ABC59076, dated Jun. 6, 2007 (1 page).
GenBank Accession No. ABC98596, dated Jan. 31, 2014 (2 pages).
GenBank Accession No. ABD60225, dated May 28, 2008 (2 pages).
GenBank Accession No. ABD92926, dated Oct. 10, 2007 (2 pages).
GenBank Accession No. AC133334, dated Jan. 31, 2004 (44 pages).
GenBank Accession No. ACD93722, dated Jun. 10, 2008 (1 page).
GenBank Accession No. AF034774, dated Apr. 17, 1998 (2 pages).
GenBank Accession No. AY562490, dated May 23, 2006 (3 pages).
GenBank Accession No. BAA43200, dated Mar. 13, 1999 (2 pages).
GenBank Accession No. BAB59027, dated Jan. 30, 2002 (1 page).
GenBank Accession No. BAF61135, dated May 9, 2007 (2 pages).
GenBank Accession No. BAG30962, dated Nov. 12, 2012 (2 pages).
GenBank Accession No. BC153262, dated Oct. 4, 2007 (3 pages).
GenBank Accession No. CAA75568, dated Nov. 14, 2006 (2 pages).
GenBank Accession No. CAA76703, dated Nov. 14, 2006 (1 page).
GenBank Accession No. CAE09055, dated Nov. 14, 2006 (2 pages).
GenBank Accession No. CAG41604, dated Feb. 6, 2015 (2 pages).
GenBank Accession No. DQ3988713, dated May 28, 2008 (2 pages).
GenBank Accession No. EDY51667, dated Sep. 2, 2008 (2 pages).
GenBank Accession No. EU263989, dated Jun. 11, 2008 (2 pages).

(56) References Cited

OTHER PUBLICATIONS

GenBank Accession No. NM_116512, dated Jan. 22, 2014 (3 pages).
GenBank Accession No. NP_001105097, dated Aug. 4, 2015 (2 pages).
GenBank Accession No. NP_013636.1 (YML075C), dated Jul. 16, 2015 (3 pages).
GenBank Accession No. NP_194183, dated Jan. 22, 2014 (4 pages).
GenBank Accession No. NP_195399, dated Jan. 22, 2014 (3 pages).
GenBank Accession No. NP_197872.1, dated Jan. 22, 2014 (2 pages).
GenBank Accession No. Q9UVY5.1, dated Apr. 1, 2015 (3 pages).
Communication of a Notice of Opposition issued by the European Patent Office for European Application No. 12750513.9, dated Mar. 6, 2017 (pp. 1-8).
Statement of fact and arguments in support of opposition, dated Feb. 28, 2017 (pp. 1-24).
Uniprot Accession No. Q75I83, dated Jul. 5, 2004 (pp. 1-2).
Uniprot Accession No. Q75I83, dated Jul. 22, 2008 (pp. 1-4).
Sequence Alignment (pp. 1-2).
Uniprot Accession No. P38125, dated Feb. 17, 2016 (pp. 1-11).
Uniprot Accession No. P39709, dated Jan. 20, 2016 (pp. 1-10).
Uniprot Accession No. P38176, dated Feb. 17, 2016 (pp. 1-9).
Uniprot Accession No. P07251, dated Jan. 20, 2016 (pp. 1-11).
Uniprot Accession No. P38142, dated Jan. 20, 2016 (pp. 1-11).
Uniprot Accession No. P38359, dated Feb. 17, 2016 (pp. 1-11).
Uniprot Accession No. P25594, dated Feb. 17, 2016 (pp. 1-9).
Uniprot Accession No. P25621, dated Feb. 17, 2016 (pp. 1-10).
Uniprot Accession No. P17261, dated Dec. 9, 2015 (pp. 1-10).
Uniprot Accession No. Q99385, dated Jan. 20, 2016 (pp. 1-10).
Uniprot Accession No. P17255, dated Jan. 20, 2016 (pp. 1-14).
Uniprot Accession No. P10870, dated Feb. 17, 2016 (pp. 1-12).
Uniprot Accession No. P32837, dated Feb. 17, 2016 (pp. 1-10).
Uniprot Accession No. Q12298, dated Nov. 11, 2015 (pp. 1-9).
Uniprot Accession No. Q12675, dated Feb. 17, 2016 (pp. 1-13).
Uniprot Accession No. Q05497, dated Jan. 20, 2016 (pp. 1-9).
Uniprot Accession No. Q04182, dated Feb. 17, 2016 (pp. 1-12).
Uniprot Accession No. P39932, dated Feb. 17, 2016 (pp. 1-11).
Uniprot Accession No. P39986, dated Feb. 17, 2016 (pp. 1-13).
Uniprot Accession No. P32660, dated Feb. 17, 2016 (pp. 1-13).
Uniprot Accession No. P43581, dated Feb. 17, 2016 (pp. 1-11).
Uniprot Accession No. P38929, dated Feb. 17, 2016 (pp. 1-12).
Uniprot Accession No. P12383, dated Feb. 17, 2016 (pp. 1-11).
Uniprot Accession No. P32804, dated Jan. 20, 2016 (pp. 1-10).
Uniprot Accession No. P53273, dated Feb. 17, 2016 (pp. 1-12).
Uniprot Accession No. P53299, dated Jan. 20, 2016 (pp. 1-9).
Uniprot Accession No. P50077, dated Feb. 17, 2016 (pp. 1-13).
Uniprot Accession No. P50080, dated Feb. 17, 2016 (pp. 1-10).
Uniprot Accession No. P53049, dated Feb. 17, 2016 (pp. 1-13).
Uniprot Accession No. P33413, dated Feb. 17, 2016 (pp. 1-13).
Uniprot Accession No. P40501, dated Feb. 17, 2016 (pp. 1-10).
Uniprot Accession No. P40310, dated Feb. 17, 2016 (pp. 1-11).
Uniprot Accession No. P40309, dated Jan. 20, 2016 (pp. 1-11).
Uniprot Accession No. P42946, dated Nov. 11, 2015 (pp. 1-9).
Uniprot Accession No. P40897, dated Jan. 20, 2016 (pp. 1-11).
Uniprot Accession No. P47144, dated Jan. 20, 2016 (pp. 1-9).
Uniprot Accession No. P0CE00, dated Feb. 17, 2016 (pp. 1-10).
Uniprot Accession No. P35724, dated Jan. 20, 2016 (pp. 1-10).
Uniprot Accession No. P28584, dated Feb. 17, 2016 (pp. 1-10).
Uniprot Accession No. P36172, dated Feb. 17, 2016 (pp. 1-10).
Uniprot Accession No. P36173, dated Feb. 17, 2016 (pp. 1-10).
Uniprot Accession No. P32366, dated Nov. 11, 2015 (pp. 1-10).
Uniprot Accession No. P13090, dated Feb. 17, 2016 (pp. 1-12).
Uniprot Accession No. Q05131, dated Feb. 17, 2016 (pp. 1-12).
Uniprot Accession No. P04710, dated Feb. 17, 2016 (pp. 1-11).
Uniprot Accession No. Q04835, dated Jan. 20, 2016 (pp. 1-10).
Uniprot Accession No. P53943, dated Feb. 17, 2016 (pp. 1-11).
Uniprot Accession No. P53507, dated Dec. 9, 2015 (pp. 1-9).
Uniprot Accession No. D6W196, dated Feb. 17, 2016 (pp. 1-11).
Uniprot Accession No. P53932, dated Jan. 20, 2016 (pp. 1-9).
Uniprot Accession No. P07213, dated Feb. 17, 2016 (pp. 1-12).
Uniprot Accession No. P41948, dated Feb. 17, 2016 (pp. 1-12).
Uniprot Accession No. P38967, dated Feb. 17, 2016 (pp. 1-12).
Uniprot Accession No. Q08234, dated Feb. 17, 2016 (pp. 1-12).
Uniprot Accession No. P81451, dated Nov. 11, 2015 (pp. 1-8).
Uniprot Accession No. P38925, dated Jan. 20, 2016 (pp. 1-11).
Uniprot Accession No. Q12067, dated Dec. 9, 2015 (pp. 1-9).
Uniprot Accession No. Q12324, dated Jan. 20, 2016 (pp. 1-10).
Uniprot Accession No. Q99252, dated Jan. 20, 2016 (pp. 1-10).
Uniprot Accession No. Q12375, dated Feb. 17, 2016 (pp. 1-10).
Uniprot Accession No. Q99297, dated Feb. 17, 2016 (pp. 1-10).
Uniprot Accession No. Q12697, dated Feb. 17, 2016 (pp. 1-12).
Uniprot Accession No. Q08777, dated Feb. 17, 2016 (pp. 1-11).
Uniprot Accession No. P32798, dated Feb. 17, 2016 (pp. 1-11).
Uniprot Accession No. Q01926, dated Feb. 17, 2016 (pp. 1-9).
Uniprot Accession No. P05626, dated Feb. 17, 2016 (pp. 1-10).
Uniprot Accession No. P33311, dated Dec. 9, 2015 (pp. 1-11).
Uniprot Accession No. Q08986, dated Feb. 17, 2016 (pp. 1-12).
Uniprot Accession No. P53394, dated Feb. 17, 2016 (pp. 1-10).
Uniprot Accession No. Q12251, dated Feb. 17, 2016 (pp. 1-9).
Uniprot Accession No. P32331, dated Feb. 17, 2016 (pp. 1-9).
Uniprot Accession No. Q06497, dated Feb. 17, 2016 (pp. 1-10).
Uniprot Accession No. Q06598, dated Feb. 17, 2016 (pp. 1-13).
Uniprot Accession No. P38124, dated Feb. 17, 2016 (pp. 1-9).
Uniprot Accession No. P05316, dated Jan. 20, 2016 (pp. 1-10).
Uniprot Accession No. P38227, dated Feb. 17, 2016 (pp. 1-11).
Uniprot Accession No. P38355, dated Jan. 20, 2016 (pp. 1-9).
Uniprot Accession No. P38360, dated Feb. 17, 2016 (pp. 1-13).
Uniprot Accession No. P38361, dated Jan. 20, 2016 (pp. 1-10).
Uniprot Accession No. P25568, dated Jan. 20, 2016 (pp. 1-11).
Uniprot Accession No. P25371, dated Jan. 20, 2016 (pp. 1-13).
Uniprot Accession No. Q07376, dated Jan. 20, 2016 (pp. 1-10).
Uniprot Accession No. Q12154, dated Dec. 9, 2015 (pp. 1-12).
Uniprot Accession No. P54854, dated Feb. 17, 2016 (pp. 1-10).
Uniprot Accession No. P0CD99, dated Feb. 17, 2016 (pp. 1-10).
Uniprot Accession No. P32568, dated Feb. 17, 2016 (pp. 1-12).
Uniprot Accession No. P32916, dated Jan. 20, 2016 (pp. 1-10).
Uniprot Accession No. P30605, dated Feb. 17, 2016 (pp. 1-12).
Uniprot Accession No. P39953, dated Feb. 17, 2016 (pp. 1-10).
Uniprot Accession No. P25515, dated Jan. 20, 2016 (pp. 1-11).
Uniprot Accession No. P39980, dated Feb. 17, 2016 (pp. 1-10).
Uniprot Accession No. P52871, dated Nov. 11, 2015 (pp. 1-9).
Uniprot Accession No. P40035, dated Feb. 17, 2016 (pp. 1-10).
Uniprot Accession No. P40074, dated Jan. 20, 2016 (pp. 1-10).
Uniprot Accession No. P43569, dated Dec. 9, 2015 (pp. 1-9).
Uniprot Accession No. P43617, dated Feb. 17, 2016 (pp. 1-9).
Uniprot Accession No. P53154, dated Jan. 20, 2016 (pp. 1-10).
Uniprot Accession No. P53142, dated Jan. 20, 2016 (pp. 1-11).
Uniprot Accession No. P53134, dated Jan. 20, 2016 (pp. 1-9).
Uniprot Accession No. P13586, dated Feb. 17, 2016 (pp. 1-12).
Chen et al., "Progress in the Application of Affinity Tags for the Expression and Purification of Recombinant Proteins," China Biotechnology, vol. 32, No. 12, pp. 93-103, Dec. 15, 2012 (English Abstract).
Giaever & Nislow, "The yeast deletion collection: a decade of functional genomics," Genetics 197(2):451-65 (Jun. 2014).

* cited by examiner

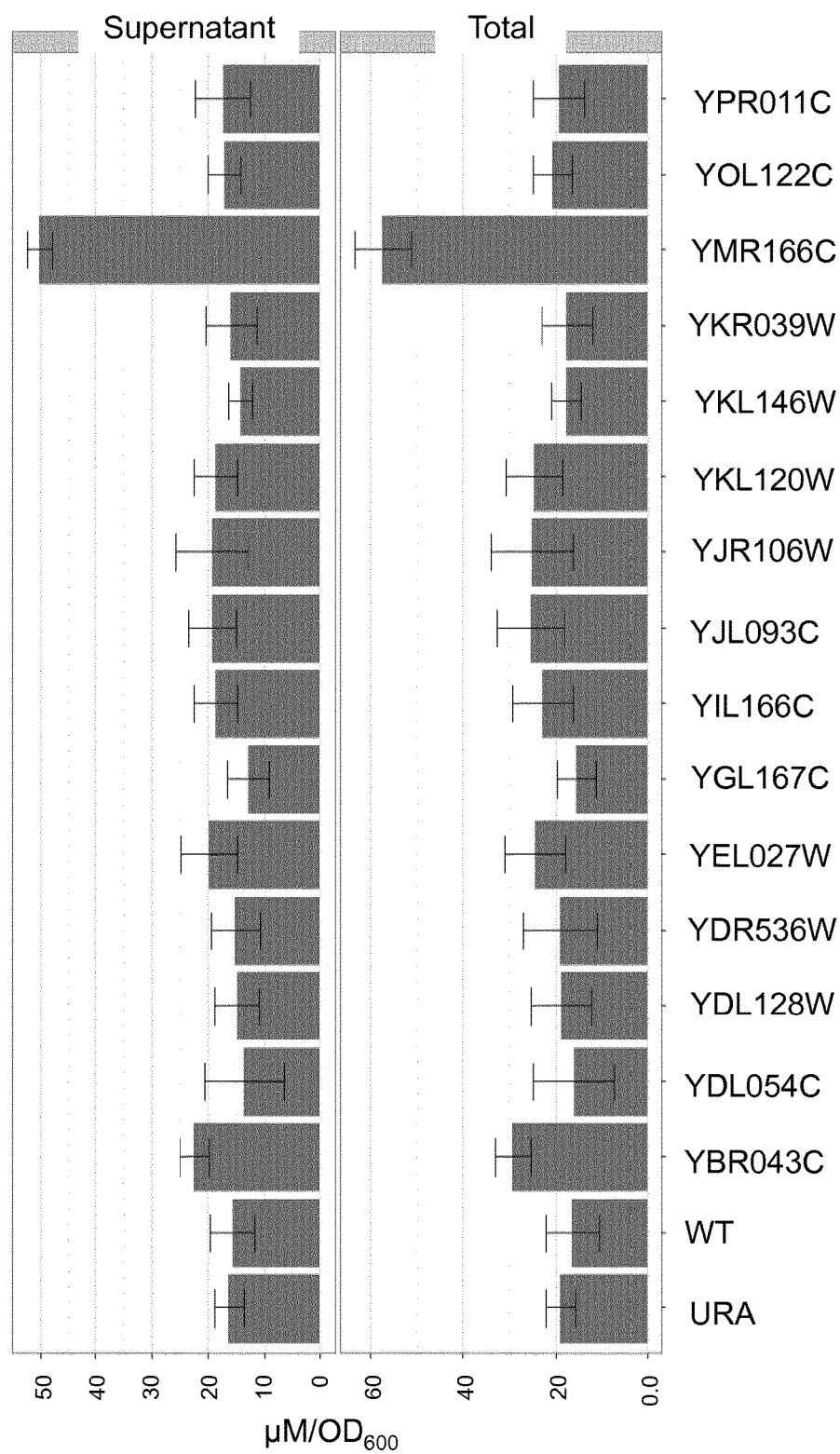

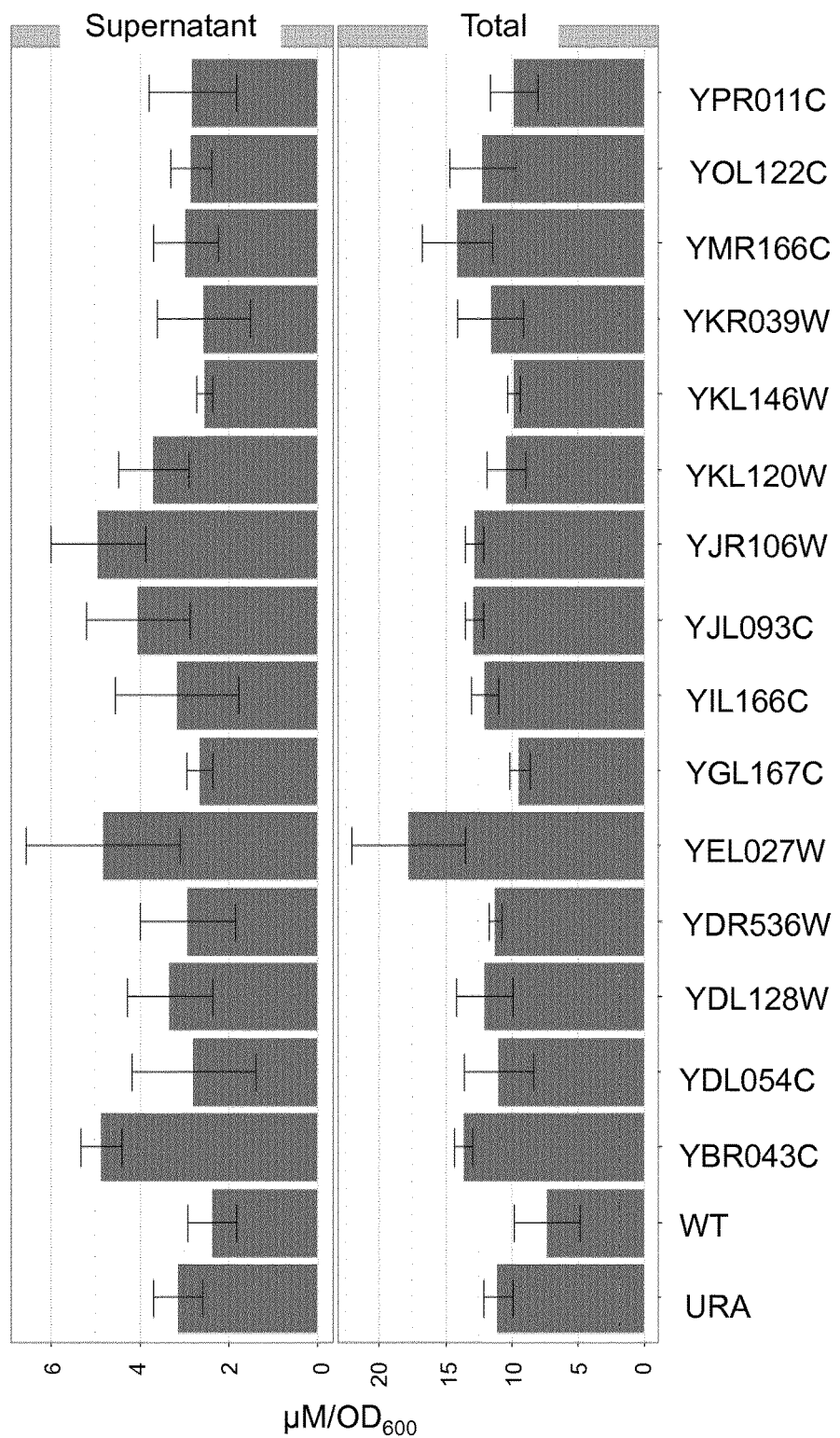

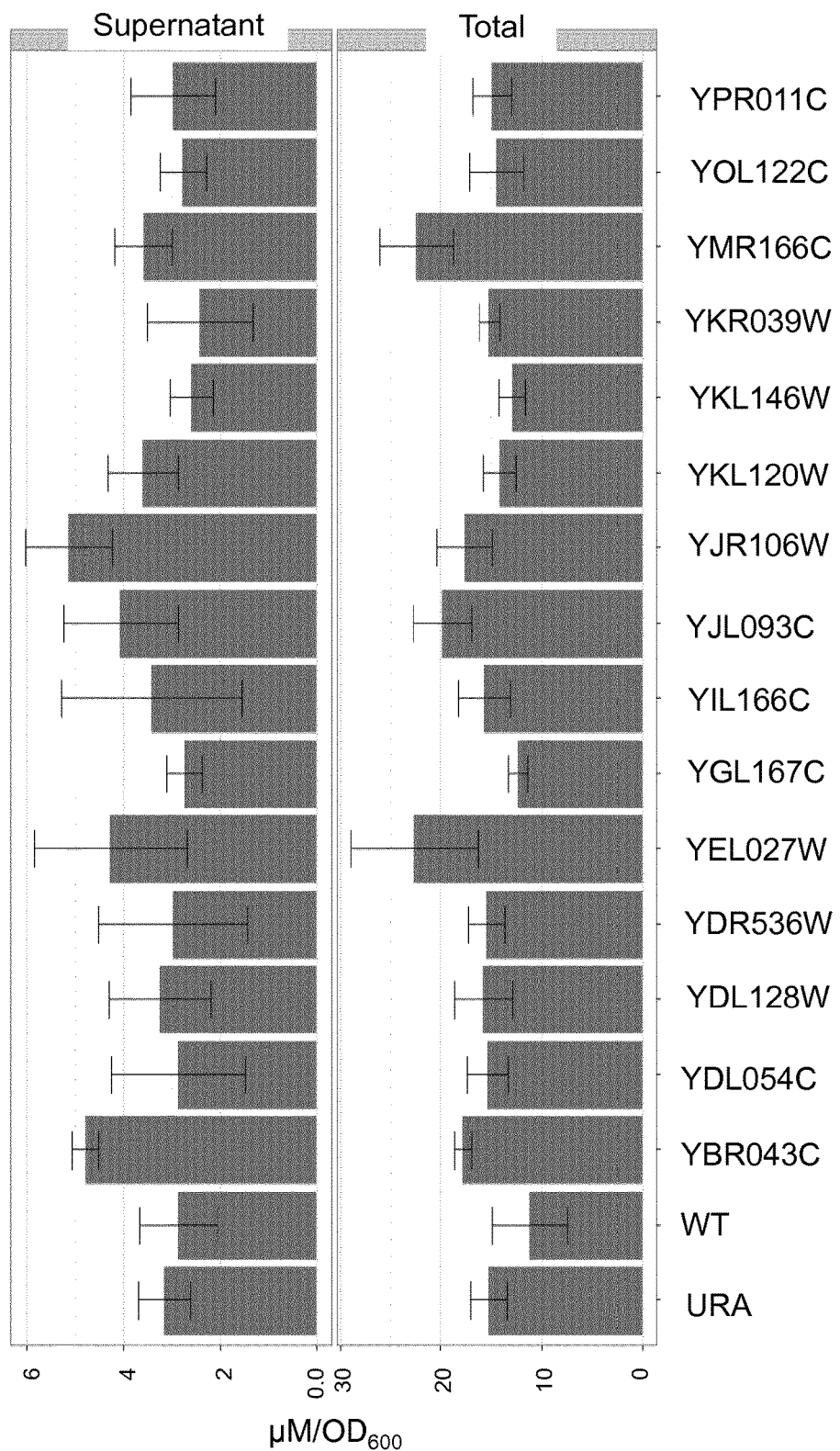

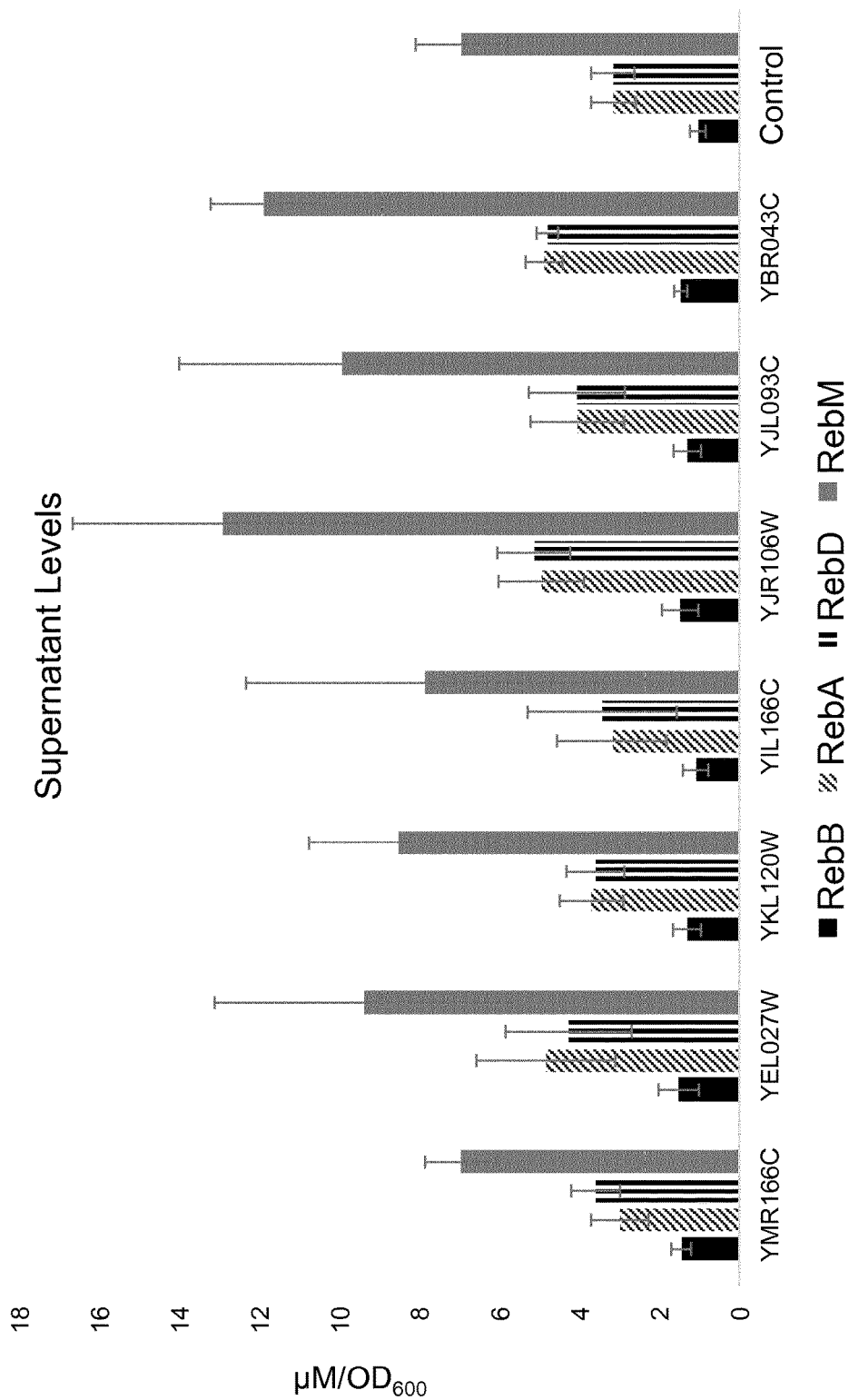

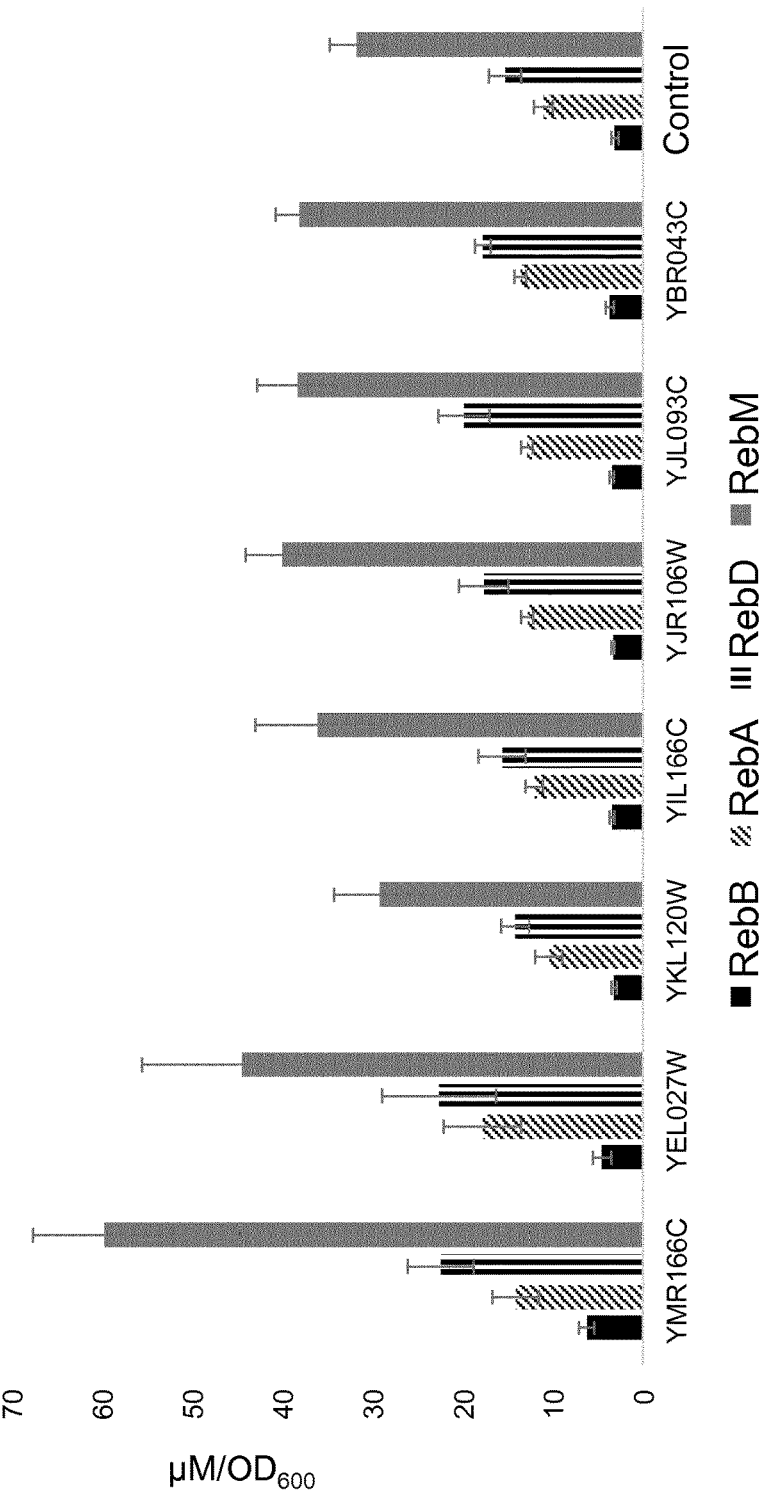

PRODUCTION OF STEVIOL GLYCOSIDES IN RECOMBINANT HOSTS

BACKGROUND OF THE INVENTION

Field of the Invention

This disclosure relates generally to the recombinant production of steviol glycosides such as rebaudioside A (RebA), rebaudioside B (RebB), rebaudioside D (RebD), and rebaudioside M (RebM) by recombinant hosts such as recombinant microorganisms and isolation methods thereof. In particular, this disclosure relates to modifications to transport systems in a recombinant host to increase production of such steviol glycosides and/or transport of such steviol glycosides into the culture medium.

Description of Related Art

Sweeteners are well known as ingredients used most commonly in the food, beverage, or confectionary industries. The sweetener can either be incorporated into a final food product during production or for stand-alone use, when appropriately diluted, as a tabletop sweetener or an at-home replacement for sugars in baking. Sweeteners include natural sweeteners such as sucrose, high fructose corn syrup, molasses, maple syrup, and honey and artificial sweeteners such as aspartame, saccharine, and sucralose. *Stevia* extract is a natural sweetener that can be isolated and extracted from a perennial shrub, *Stevia rebaudiana*. *Stevia* is commonly grown in South America and Asia for commercial production of *Stevia* extract. *Stevia* extract, purified to various degrees, is used commercially as a high intensity sweetener in foods and in blends or alone as a tabletop sweetener.

Chemical structures for several steviol glycosides are shown in FIG. 1, including the diterpene steviol and various steviol glycosides. Extracts of the *Stevia* plant generally comprise rebaudiosides and other steviol glycosides that contribute to the sweet flavor, although the amount of each steviol glycoside often varies, inter alia, among different production batches.

As recovery and purification of steviol glycosides from the *Stevia* plant have proven to be labor intensive and inefficient, there remains a need for a recombinant production system that can produce high yields of desired steviol glycosides, such as RebD and RebM.

SUMMARY OF THE INVENTION

It is against the above background that the present invention provides certain advantages and advancements over the prior art.

In particular, the invention provides a recombinant host capable of synthesizing a steviol glycoside, comprising a gene encoding a transporter polypeptide and/or a gene encoding a transcription factor polypeptide that regulates expression of at least one transporter gene; wherein expression of the gene encoding the transporter polypeptide and/or the gene encoding the transcription factor polypeptide that regulates expression of at least one transporter gene is modified and the recombinant host transports at least a portion of the synthesized steviol glycoside from the host into a culture medium.

In some aspects of the recombinant host disclosed herein, the gene encoding the transporter polypeptide is an endogenous gene.

In some aspects of the recombinant host disclosed herein, the transporter polypeptide comprises an ATP-binding cassette (ABC) transporter, a major facilitator superfamily (MFS) transporter, an amino acid/auxin permease (AAAP) family transporter, ATPase transporter, a sulfate permease (SulP) family transporter, a lysosomal cystine transporter (LCT) family transporter, a Ca2+:cation antiporter (CaCA) family transporter, an amino acid-polyamine-organocation (APC) superfamily transporter, a multidrug/oligosaccharidyl-lipid/polysaccharide (MOP) transporter, a ZRT/IRT-like protein (ZIP) metal transporter family transporter, a mitochondrial protein translocase (MPT) family transporter, a voltage-gated ion channel (VIC) family transporter, a monovalent cation:proton antiporter-2 (CPA2) family transporter, a ThrE family of putative transmembrane amino acid efflux transporter, an oligopeptide transporter (OPT) family transporter, a K$^+$ transporter (Trk) family transporter, a bile acid:Na symporter (BASS) family transporter, a drug/metabolite transporter (DMT) superfamily transporter, a mitochondrial carrier (MC) family transporter, an auxin efflux carrier (AEC) family transporter, an ammonia channel transporter (Amt) family transporter, a metal ion (Mn$^{2+}$-iron) transporter (Nramp) family transporter, a transient receptor potential Ca$^{2+}$ channel (TRP-CC) family transporter, an arsenical resistance-3 (ACR3) family transporter, a nucleobase:cation symporter-1 (NCS1) family transporter, an inorganic phosphate transporter (PiT) family transporter, an arsenite-antimonite (ArsAB) efflux family transporter, an IISP family of transporter, a glycerol uptake (GUP) family transporter, a metal ion transport (MIT) family transporter, a copper transport (Ctr) family or a cation diffusion facilitator (CDF) family transporter.

In some aspects of the recombinant host disclosed herein, the modified expression comprises modified expression comprises:
(a) overexpressing the gene encoding the transporter polypeptide and/or the gene encoding the transcription factor polypeptide; or
(b) deleting the gene encoding the transporter polypeptide and/or the gene encoding the transcription factor polypeptide.

In some aspects of the recombinant host disclosed herein, the gene encoding the transporter polypeptide and/or the gene encoding the transcription factor polypeptide has an activity that is increased.

In some aspects of the recombinant host disclosed herein, one or more of the genes encoding the transporter polypeptide and/or one or more of the genes encoding the transcription factor polypeptide are overexpressed.

In some aspects of the recombinant host disclosed herein, the transporter polypeptide and/or transcription polypeptide comprise YAL067C set forth in SEQ ID NO:14, YBL089W set forth in SEQ ID NO:15, YBL099W set forth in SEQ ID NO:16, YBR008C set forth in SEQ ID NO:86, YBR021W set forth in SEQ ID NO:87, YBR043C set forth in SEQ ID NO:88, YBR180W set forth in SEQ ID NO:13, YBR241C set forth in SEQ ID NO:17, YBR287W set forth in SEQ ID NO:89, YBR294W set forth in SEQ ID NO:18, YBR295W set forth in SEQ ID NO:90, YBR296C set forth in SEQ ID NO:91, YCL038C set forth in SEQ ID NO:92, YCL069W set forth in SEQ ID NO:19, YCR011C set forth in SEQ ID NO:93, YCR028C set forth in SEQ ID NO:20, YCR075C set forth in SEQ ID NO:21, YDL054C set forth in SEQ ID NO:94, YDL100C set forth in SEQ ID NO:95, YDL128W set forth in SEQ ID NO:22, YDL185W set forth in SEQ ID NO:23, YDL194W set forth in SEQ ID NO:24, YDL210W set forth in SEQ ID NO:25, YDL245C set forth in SEQ ID NO:96, YDL247W set forth in SEQ ID NO:97, YDR011W set forth in SEQ ID NO:98, YDR061W set forth in SEQ ID NO:26, YDR093W set forth in SEQ ID NO:27, YDR292C set forth in SEQ ID NO:99, YDR338C set forth in SEQ ID NO:28, YDR406W set forth in SEQ ID NO:29, YDR497C set forth in SEQ ID NO:100, YDR536W set forth in SEQ ID NO:30, YEL006W set forth in SEQ ID NO:101, YEL027W set forth in SEQ ID NO:102, YEL031W set forth in SEQ ID NO:31, YEL065W set forth in SEQ ID NO:103, YER019C-A set forth in SEQ ID NO:104, YER053C set forth in SEQ ID NO:105, YER119C set forth in SEQ ID NO:106, YER166W set forth in SEQ ID NO:32, YFL011W set forth in SEQ ID NO:33, YFL028C set forth in SEQ ID NO:107, YFR045W set forth in SEQ ID NO:108, YGL006W set forth in SEQ ID NO:34, YGL013C set forth in SEQ ID NO:35, YGL084C set forth in SEQ ID NO:109, YGL104C set forth in SEQ ID NO:110, YGL114W set forth in SEQ ID NO:111, YGL167C set forth in SEQ ID NO:112, YGL255W set forth in SEQ ID NO:36, YGR125W set forth in SEQ ID NO:37, YGR181W set forth in SEQ ID NO:38, YGR217W set forth in SEQ ID NO:39, YGR224W set forth in SEQ ID NO:40, YGR257C set forth in SEQ ID NO:113, YGR281W set forth in SEQ ID NO:41, YHL016C set forth in SEQ ID NO:42, YHL035C set forth in SEQ ID NO:114, YHL036W set forth in SEQ ID NO:115, YHR002W set forth in SEQ ID NO:116, YHR096C set forth in SEQ ID NO:117, YIL006W set forth in SEQ ID NO:118, YIL088C set forth in SEQ ID NO:43, YIL120W set forth in SEQ ID NO:119, YIL121W set forth in SEQ ID NO:120, YIL166C set forth in SEQ ID NO:121, YJL093C set forth in SEQ ID NO:44, YJL094C set forth in SEQ ID NO:45, YJL108C set forth in SEQ ID NO:46, YJL133W set forth in SEQ ID NO:122, YJL212C set forth in SEQ ID NO:47, YJL219W set forth in SEQ ID NO:123, YJR106W set forth in SEQ ID NO:48, YJR160C set forth in SEQ ID NO:49, YKL016C set forth in SEQ ID NO:124, YKL050C set forth in SEQ ID NO:125, YKL064W set forth in SEQ ID NO:50, YKL120W set forth in SEQ ID NO:126, YKL146W set forth in SEQ ID NO:127, YKL209C set forth in SEQ ID NO:128, YKR039W set forth in SEQ ID NO:129, YKR050W set forth in SEQ ID NO:51, YKR105C set forth in SEQ ID NO:52, YKR106W set forth in SEQ ID NO:53, YLR411W set forth in SEQ ID NO:130, YLR447C set forth in SEQ ID NO:54, YML038C set forth in SEQ ID NO:131, YML116W set forth in SEQ ID NO:55, YMR034C set forth in SEQ ID NO:56, YMR056C set forth in SEQ ID NO:57, YMR166C set forth in SEQ ID NO:132, YMR253C set forth in SEQ ID NO:58, YMR279C set forth in SEQ ID NO:133, YNL003C set forth in SEQ ID NO:134, YNL065W set forth in SEQ ID NO:59, YNL070W set forth in SEQ ID NO:60, YNL083W set forth in SEQ ID NO:61, YNL095C set forth in SEQ ID NO:62, YNL121C set forth in SEQ ID NO:63, YNL142W set forth in SEQ ID NO:64, YNL268W set forth in SEQ ID NO:135, YNR055C set forth in SEQ ID NO:136, YOL020W set forth in SEQ ID NO:65, YOL075C set forth in SEQ ID NO:66, YOL077W-A set forth in SEQ ID NO:67, YOL122C set forth in SEQ ID NO:68, YOL158C set forth in SEQ ID NO:137, YOR079C set forth in SEQ ID NO:69, YOR087W set forth in SEQ ID NO:70, YOR092W set forth in SEQ ID NO:71, YOR100C set forth in SEQ ID NO:138, YOR130C set forth in SEQ ID NO:72, YOR153W set forth in SEQ ID NO:139, YOR222W set forth in SEQ ID NO:73, YOR271C set forth in SEQ ID NO:140, YOR273C set forth in SEQ ID NO:141, YOR291W set forth in SEQ ID NO:74, YOR306C set forth in SEQ ID NO:75, YOR307C set forth in SEQ ID NO:142, YOR316C set forth in SEQ ID NO:76, YOR332W set forth in SEQ ID NO:143, YOR334W set forth in SEQ ID NO:77, YOR348C set forth in SEQ ID NO:144, YPL036W set forth in SEQ ID NO:145, YPL078C set forth in SEQ ID NO:78, YPL270W set forth in SEQ ID NO:79, YPL274W set forth in SEQ ID NO:80, YPR003C set forth in SEQ ID NO:81, YPR011C set forth in SEQ ID NO:82, YPR058W set forth in SEQ ID NO:83, YPR128C set forth in SEQ ID NO:84, or YPR201W set forth in SEQ ID NO:85.

In some aspects of the recombinant host disclosed herein, YBR043C set forth in SEQ ID NO:88, YDL100C set forth in SEQ ID NO:95, YDL054C set forth in SEQ ID NO:94, YDL128W set forth in SEQ ID NO:22, YDL198C set forth in SEQ ID NO:146, YDR061W set forth in SEQ ID NO:26, YDR536W set forth in SEQ ID NO:30, YEL027W set forth in SEQ ID NO:102, YFL054C set forth in SEQ ID NO:147, YGL167C set forth in SEQ ID NO:112, YGR181W set forth in SEQ ID NO:38, YHL016C set forth in SEQ ID NO:42, YIL166C set forth in SEQ ID NO:121, YJL093C set forth in SEQ ID NO:44, YJR106W set forth in SEQ ID NO:48, YKL120W set forth in SEQ ID NO:126, YKL146W set forth in SEQ ID NO:127, YKR039W set forth in SEQ ID NO:129, YMR034C set forth in SEQ ID NO:56, YMR166C set forth in SEQ ID NO:132, YOL122C set forth in SEQ ID NO:68, YOR079C set forth in SEQ ID NO:69, YPL270W set forth in SEQ ID NO:79, and/or YPR011C set forth in SEQ ID NO:82 are overexpressed.

In some aspects, the recombinant host further comprises:
(a) one or more genes encoding a sucrose transporter and a sucrose synthase;
(b) a gene encoding a geranylgeranyl diphosphate synthase (GGPPS) polypeptide;
(c) a gene encoding an ent-copalyl diphosphate synthase (CDPS) polypeptide;
(d) a gene encoding a kaurene synthase (KS) polypeptide;
(e) a gene encoding a kaurene oxidase (KO) polypeptide;
(f) a gene encoding a steviol synthase (KAH) polypeptide;
(g) a gene encoding a cytochrome P450 reductase (CPR) polypeptide;
(h) a gene encoding a UGT85C2 polypeptide;
(i) a gene encoding a UGT76G1 polypeptide;
(k) a gene encoding a UGT91D2 functional homolog; and/or
(l) a gene encoding a EUGT11 polypeptide;
wherein at least one of the genes is a recombinant gene; and
wherein the host is capable of producing one or more of RebA, RebB, RebD and/or RebM.

In some aspects of the recombinant host disclosed herein, at least one of the genes is codon optimized for expression in the host.

In some aspects of the recombinant host disclosed herein, at least one of the genes is codon optimized for expression in *Saccharomyces cerevisiae*.

In some aspects of the recombinant host disclosed herein,
(a) the GGPPS polypeptide comprises a polypeptide having at least 70% identity to an amino acid sequence set forth in SEQ ID NO:149;
(b) the CDPS polypeptide comprises a polypeptide having at least 70% identity to an amino acid sequence set forth in SEQ ID NO:150;
(c) the KO polypeptide comprises a polypeptide having at least 70% identity to an amino acid sequence set forth in SEQ ID NO:152;
(d) the KS polypeptide comprises a polypeptide having at least 40% identity to an amino acid sequence set forth in SEQ ID NO:151;
(e) the KAH polypeptide comprises a polypeptide having at least 60% identity to an amino acid sequence set forth in SEQ ID NO:154;
(f) the CPR polypeptide comprises a polypeptide having at least 70% identity to an amino acid sequence set forth in SEQ ID NO:153 and/or a polypeptide having at least 65% identity to an amino acid sequence set forth in SEQ ID NO:155;

(g) the UGT85C2 polypeptide comprises a polypeptide having at least 55% identity to an amino acid sequence set forth in SEQ ID NO:156;

(h) the UGT76G1 polypeptide comprises a polypeptide having at least 50% identity to an amino acid sequence set forth in SEQ ID NO:158;

(i) the UGT74G1 polypeptide comprises a polypeptide having at least 55% identity to an amino acid sequence set forth in SEQ ID NO:157;

(j) the a UGT91D2 functional homolog comprises a UGT91D2e-b polypeptide having at least 90% identity to the amino acid sequence set forth in SEQ ID NO:159; and (k) the EUGT11 polypeptide comprises a polypeptide having at least 65% identity to an amino acid sequence set forth in SEQ ID NO:148.

In some aspects, the recombinant host disclosed herein comprises a microorganism that is a plant cell, a mammalian cell, an insect cell, a fungal cell, or a bacterial cell.

In some aspects, the bacterial cell comprises *Escherichia* bacteria cells, *Lactobacillus* bacteria cells, *Lactococcus* bacteria cells, *Cornebacterium* bacteria cells, *Acetobacter* bacteria cells, *Acinetobacter* bacteria cells, or *Pseudomonas* bacterial cells.

In some aspects, the fungal cell is a yeast cell.

In some aspects, the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous*, or *Candida albicans* species.

In some aspects, the yeast cell is a Saccharomycete.

In some aspects, the yeast cell is a cell from the *Saccharomyces cerevisiae* species.

The invention further provides a method of producing a steviol glycoside, comprising:
(a) growing the recombinant host disclosed herein in a culture medium, under conditions in which the genes comprising recombinant host disclosed herein are expressed, wherein the steviol glycoside is synthesized by the host; and
(b) optionally isolating the steviol glycoside.

In some aspects of the methods disclosed herein, the steviol glycoside is RebA, RebB, RebD, and/or RebM, and wherein:
(a) RebA is capable of being synthesized in the recombinant host disclosed herein expressing UGT85C2, UGT76G1, UGT74G1, and UGT91D2;
(b) RebB is capable of being synthesized in the recombinant host disclosed herein expressing UGT85C2, UGT76G1, and UGT91D2;
(c) RebD is capable of being synthesized in the recombinant host disclosed herein expressing UGT85C2, UGT76G1, UGT74G1, and UGT91D2 and/or EUGT11; and
(d) RebM is capable of being synthesized in the recombinant host disclosed herein expressing UGT85C2, UGT76G1, UGT74G1, and UGT91D2 and/or EUGT11.

In some aspects of the methods disclosed herein a gene encoding YBR043C set forth in SEQ ID NO:88, YDL100C set forth in SEQ ID NO:95, YDL054C set forth in SEQ ID NO:94, YDL128W set forth in SEQ ID NO:22, YDL198C set forth in SEQ ID NO:146, YDR061W set forth in SEQ ID NO:26, YDR536W set forth in SEQ ID NO:30, YEL027W set forth in SEQ ID NO:102, YFL054C set forth in SEQ ID NO:147, YGL167C set forth in SEQ ID NO:112, YGR181W set forth in SEQ ID NO:38, YHL016C set forth in SEQ ID NO:42, YIL166C set forth in SEQ ID NO:121, YJL093C set forth in SEQ ID NO:44, YJR106W set forth in SEQ ID NO:48, YKL120W set forth in SEQ ID NO:126, YKL146W set forth in SEQ ID NO:127, YKR039W set forth in SEQ ID NO:129, YMR034C set forth in SEQ ID NO:56, YMR166C set forth in SEQ ID NO:132, YOL122C set forth in SEQ ID NO:68, YOR079C set forth in SEQ ID NO:69, YPL270W set forth in SEQ ID NO:79, and/or YPR011C set forth in SEQ ID NO:82 is overexpressed.

In some aspects of the methods disclosed herein the steviol glycoside is produced at a concentration of between about 500 mg/L to about 10,000 mg/L.

The invention further provides a method of increasing production or transport of a steviol glycoside into a culture medium, comprising:
(a) growing the recombinant host disclosed herein in a culture medium, under conditions in which the genes comprising the host disclosed herein are expressed, wherein the steviol glycoside is synthesized by the host; and
(b) optionally isolating the steviol glycoside.

In some aspects of the methods disclosed herein, the steviol glycoside is RebA, RebB, RebD, and/or RebM.

The invention further provides a method increasing production of steviol or a steviol glycoside in a recombinant host, comprising modifying expression of a gene encoding a transporter polypeptide and/or a gene encoding a transcription that regulates expression of at least one transporter gene, wherein the host is capable of transporting at least a portion of the produced steviol or a steviol glycoside from the host into a culture medium.

These and other features and advantages of the present invention will be more fully understood from the following detailed description of the invention taken together with the accompanying claims. It is noted that the scope of the claims is defined by the recitations therein and not by the specific discussion of features and advantages set forth in the present description.

DESCRIPTION OF DRAWINGS

FIG. 4A shows levels of 13-SMG (total levels and supernatant levels; $\mu M/OD_{600}$), FIG. 4B shows levels of RebA (total levels and supernatant levels; $\mu M/OD_{600}$), FIG. 4D shows levels of RebD (total levels and supernatant levels; $\mu M/OD_{600}$)

FIG. 5A shows supernatant levels of RebA, RebB, RebD, and RebM (in μM/OD$_{600}$) of a steviol glycoside-producing strain overexpressing YMR166C (SEQ ID NO:132), YEL027W (SEQ ID NO:102), YKL120W (SEQ ID NO:126), YIL166C (SEQ ID NO:121), YJR106W (SEQ ID NO:48), YJL093C (SEQ ID NO:44), and YBR043C (SEQ ID NO:88) by the USER cloning system. FIG. 5B shows total levels of RebA, RebB, RebD, and RebM (in μM/OD$_{600}$) of a steviol glycoside-producing strain overexpressing YMR166C (SEQ ID NO:132), YEL027W (SEQ ID NO:102), YKL120W (SEQ ID NO:126), YIL166C (SEQ ID NO:121), YJR106W (SEQ ID NO:48), YJL093C (SEQ ID NO:44), and YBR043C (SEQ ID NO:88) by the USER cloning system.

DETAILED DESCRIPTION

Figure 1:
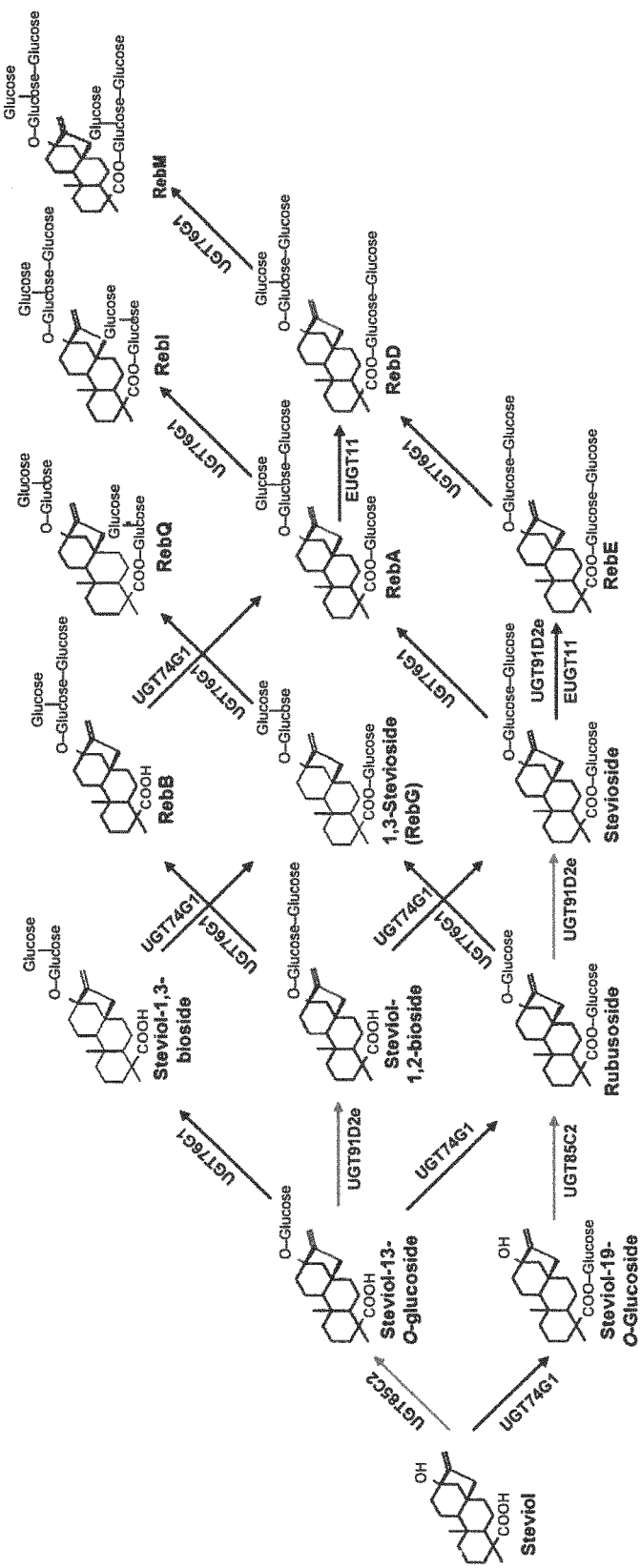
FIG. 1 shows the chemical structures and synthesis pathways for various steviol glycosides.

All publications, patents and patent applications cited herein are hereby expressly incorporated by reference in their entirety for all purposes.

Before describing the present invention in detail, a number of terms will be defined. As used herein, the singular forms "a," "an," and "the" include plural referents unless the context clearly dictates otherwise. For example, reference to "a nucleic acid" means one or more nucleic acids.

It is noted that terms like "preferably," "commonly," and "typically" are not utilized herein to limit the scope of the claimed invention or to imply that certain features are critical, essential, or even important to the structure or function of the claimed invention. Rather, these terms are merely intended to highlight alternative or additional features that can or cannot be utilized in a particular embodiment of the present invention.

For the purposes of describing and defining the present invention it is noted that the term "substantially" is utilized herein to represent the inherent degree of uncertainty that can be attributed to any quantitative comparison, value, measurement, or other representation. The term "substantially" is also utilized herein to represent the degree by which a quantitative representation can vary from a stated reference without resulting in a change in the basic function of the subject matter at issue.

Methods well known to those skilled in the art can be used to construct genetic expression constructs and recombinant cells according to this invention. These methods include in vitro recombinant DNA techniques, synthetic techniques, in vivo recombination techniques, and polymerase chain reaction (PCR) techniques. See, for example, techniques as described in Green & Sambrook, 2012, MOLECULAR CLONING: A LABORATORY MANUAL, Fourth Edition, Cold Spring Harbor Laboratory, New York; Ausubel et al., 1989, CURRENT PROTOCOLS IN MOLECULAR BIOLOGY, Greene Publishing Associates and Wiley Interscience, New York, and PCR Protocols: A Guide to Methods and Applications (Innis et al., 1990, Academic Press, San Diego, Calif.).

As used herein, the terms "polynucleotide," "nucleotide," "oligonucleotide," and "nucleic acid" can be used interchangeably to refer to nucleic acid comprising DNA, RNA, derivatives thereof, or combinations thereof.

As used herein, the terms "microorganism," "microorganism host," "microorganism host cell," "host cell," "recombinant host," "recombinant microorganism host," and "recombinant host cell" can be used interchangeably. As used herein, the term "recombinant host" is intended to refer to a host, the genome of which has been augmented by at least one DNA sequence. Such DNA sequences include but are not limited to genes that are not naturally present, DNA sequences that are not normally transcribed into RNA or translated into a protein ("expressed"), and other genes or DNA sequences which one desires to introduce into the non-recombinant host. It will be appreciated that typically the genome of a recombinant host described herein is augmented through stable introduction of one or more recombinant genes. Generally, introduced DNA is not originally resident in the host that is the recipient of the DNA, but it is within the scope of this disclosure to isolate a DNA segment from a given host, and to subsequently introduce one or more additional copies of that DNA into the same host, e.g., to enhance production of the product of a gene or alter the expression pattern of a gene. In some instances, the introduced DNA will modify or even replace an endogenous gene or DNA sequence by, e.g., homologous recombination or site-directed mutagenesis. Suitable recombinant hosts include microorganisms.

As used herein, the term "recombinant gene" refers to a gene or DNA sequence that is introduced into a recipient host, regardless of whether the same or a similar gene or DNA sequence may already be present in such a host. "Introduced," or "augmented" in this context, is known in the art to mean introduced or augmented by the hand of man. Thus, a recombinant gene can be a DNA sequence from another species or can be a DNA sequence that originated from or is present in the same species but has been incorporated into a host by recombinant methods to form a recombinant host. It will be appreciated that a recombinant gene that is introduced into a host can be identical to a DNA sequence that is normally present in the host being transformed and is introduced to provide one or more additional copies of the DNA to thereby permit overexpression or modified expression of the gene product of that DNA. Said recombinant genes are particularly encoded by cDNA.

As used herein, the term "engineered biosynthetic pathway" refers to a biosynthetic pathway that occurs in a recombinant host, as described herein, and does not naturally occur in the host.

As used herein, the term "endogenous" gene refers to a gene that originates from and is produced or synthesized within a particular organism, tissue, or cell. In some embodiments, the endogenous gene is a yeast transporter. In some embodiments, the transporter is endogenous to *S. cerevisiae*, including, but not limited to *S. cerevisiae* strain S288C. In some embodiments, an endogenous yeast transporter gene is overexpressed. As used herein, the term "overexpress" is used to refer to the expression of a gene in an organism at levels higher than the level of gene expression in a wild type organism. See, e.g., Prelich, 2012, Genetics 190:841-54. In some embodiments, an endogenous yeast transporter gene is deleted. See, e.g., Giaever & Nislow, 2014, Genetics 197 (2):451-65. As used herein, the terms "deletion," "deleted,"

"knockout," and "knocked out" can be used interchangeably to refer to an endogenous gene that has been manipulated to no longer be expressed in an organism, including, but not limited to, S. cerevisiae. In some embodiments, a deleted/knocked out gene is a transporter gene or a transcription factor gene that regulates expression of a transporter gene.

As used herein, the terms "heterologous sequence" and "heterologous coding sequence" are used to describe a sequence derived from a species other than the recombinant host. In some embodiments, the recombinant host is an S. cerevisiae cell, and a heterologous sequence is derived from an organism other than S. cerevisiae. A heterologous coding sequence, for example, can be from a prokaryotic microorganism, a eukaryotic microorganism, a plant, an animal, an insect, or a fungus different than the recombinant host expressing the heterologous sequence. In some embodiments, a coding sequence is a sequence that is native to the host.

A "selectable marker" can be one of any number of genes that complement host cell auxotrophy, provide antibiotic resistance, or result in a color change. Linearized DNA fragments of the gene replacement vector then are introduced into the cells using methods well known in the art (see below). Integration of the linear fragments into the genome and the disruption of the gene can be determined based on the selection marker and can be verified by, for example, PCR or Southern blot analysis. Subsequent to its use in selection, a selectable marker can be removed from the genome of the host cell by, e.g., Cre-LoxP systems (see, e.g., Gossen et al., 2002, Ann. Rev. Genetics 36:153-173 and U.S. 2006/0014264). Alternatively, a gene replacement vector can be constructed in such a way as to include a portion of the gene to be disrupted, where the portion is devoid of any endogenous gene promoter sequence and encodes none, or an inactive fragment of, the coding sequence of the gene.

As used herein, the terms "variant" and "mutant" are used to describe a protein sequence that has been modified at one or more amino acids, compared to the wild type sequence of a particular protein.

As used herein, the term "inactive fragment" is a fragment of the gene that encodes a protein having, e.g., less than about 10% (e.g., less than about 9%, less than about 8%, less than about 7%, less than about 6%, less than about 5%, less than about 4%, less than about 3%, less than about 2%, less than about 1%, or 0%) of the activity of the protein produced from the full-length coding sequence of the gene. Such a portion of a gene is inserted in a vector in such a way that no known promoter sequence is operably linked to the gene sequence, but that a stop codon and a transcription termination sequence are operably linked to the portion of the gene sequence. This vector can be subsequently linearized in the portion of the gene sequence and transformed into a cell. By way of single homologous recombination, this linearized vector is then integrated in the endogenous counterpart of the gene with inactivation thereof.

As used herein, the term "steviol glycoside" refers to Rebaudioside A (RebA) (CAS #58543-16-1), Rebaudioside B (RebB) (CAS #58543-17-2), Rebaudioside C (RebC) (CAS #63550-99-2), Rebaudioside D (RebD) (CAS #63279-13-0), Rebaudioside E (RebE) (CAS #63279-14-1), Rebaudioside F (RebF) (CAS #438045-89-7), Rebaudioside M (RebM) (CAS #1220616-44-3), Rubusoside (CAS #63849-39-4), Dulcoside A (CAS #64432-06-0), Rebaudioside I (RebI) (MassBank Record: FU000332), Rebaudioside Q (RebQ), 1,2-Stevioside (CAS #57817-89-7), 1,3-Stevioside (RebG), 1,2-Bioside (MassBank Record: FU000299), 1,3-Bioside, Steviol-13-O-glucoside (13-SMG), Steviol-19-O-glucoside (19-SMG), a tri-glucosylated steviol glycoside, a tetra-glycosylated steviol glycoside, a penta-glucosylated steviol glycoside, a hexa-glucosylated steviol glycoside, a hepta-glucosylated steviol glycoside, di-glucosylated kaurenoic acid, tri-glucosylated kaurenoic acid, di-glucosylated kaurenol, tri-glucosylated kaurenol, and isomers thereof.

Recombinant steviol glycoside-producing Saccharomyces cerevisiae (S. cerevisiae) strains are described in WO 2011/153378, WO 2013/022989, WO 2014/122227, and WO 2014/122328, each of which has been incorporated by reference herein in its entirety. See, also, Example 2. Methods of producing steviol glycosides in recombinant hosts, by whole cell bio-conversion, and in vitro are also described in WO 2011/153378, WO 2013/022989, WO 2014/122227, and WO 2014/122328.

In some embodiments, steviol glycosides and/or steviol glycoside precursors are produced in vivo through expression of one or more enzymes involved in the steviol glycoside biosynthetic pathway in a recombinant host. For example, a steviol-producing recombinant host expressing one or more of a gene encoding a geranylgeranyl diphosphate synthase (GGPPS) polypeptide, a gene encoding an ent-copalyl diphosphate synthase (CDPS) polypeptide, a gene encoding a kaurene synthase (KS) polypeptide, a gene encoding a kaurene oxidase polypeptide (KO), a gene encoding a steviol synthase (KAH) polypeptide, a gene encoding a cytochrome P450 reductase (CPR) polypeptide, and a gene encoding a UGT polypeptide can produce a steviol glycoside and/or steviol glycoside precursors in vivo. See Example 2.

In some embodiments, a recombinant host comprises a nucleic acid encoding a UGT85C2 polypeptide, a nucleic acid encoding a UGT76G1 polypeptide, a nucleic acid encoding a UGT74G1 polypeptide, a nucleic acid encoding a UGT91D2 polypeptide, and/or a nucleic acid encoding a EUGT11 polypeptide. The skilled worker will appreciate that expression of these genes may be necessary to produce a particular steviol glycoside but that one or more of these genes can be endogenous to the host provided that at least one (and in some embodiments, all) of these genes is a recombinant gene introduced into the microorganism. In a particular embodiment, a steviol-producing recombinant microorganism comprises exogenous nucleic acids encoding UGT85C2, UGT76G1, or UGT91D2 polypeptides. In another particular embodiment, a steviol-producing recombinant microorganism comprises exogenous nucleic acids encoding UGT85C2, UGT76G1, UGT74G1, and UGT91D2 polypeptides. In yet another particular embodiment, a steviol-producing recombinant microorganism comprises exogenous nucleic acids encoding UGT85C2, UGT76G1, UGT74G1, and EUGT11 polypeptides. In yet another particular embodiment, a steviol-producing recombinant microorganism comprises the exogenous nucleic acids encoding UGT85C2, UGT76G1, UGT74G1, UGT91D2 (including inter alia 91D2e, 91D2m, 91D2e-b, and functional homologs thereof), and EUGT11 polypeptides. See Example 2.

In certain embodiments, the steviol glycoside is RebA, RebB, RebD, and/or RebM. RebA can be synthesized in a steviol-producing recombinant microorganism expressing UGT85C2, UGT76G1, UGT74G1, and UGT91D2. RebB can be synthesized in a steviol-producing recombinant microorganism expressing UGT85C2, UGT76G1, and UGT91D2. RebD can be synthesized in a steviol-producing recombinant microorganism expressing UGT85C2, UGT76G1 UGT74G1, and UGT91D2 and/or EUGT11.

RebM can be synthesized in a steviol-producing recombinant microorganism expressing UGT85C2, UGT76G1, UGT74G1, and UGT91D2 and/or EUGT11 (see FIG. 1, Example 2).

In some embodiments, steviol glycosides and/or steviol glycoside precursors are produced through contact of a steviol glycoside precursor with one or more enzymes involved in the steviol glycoside pathway in vitro. For example, contacting steviol with a UGT polypeptide can result in production of a steviol glycoside in vitro. In some embodiments, a steviol glycoside precursor is produced through contact of an upstream steviol glycoside precursor with one or more enzymes involved in the steviol glycoside pathway in vitro. For example, contacting ent-kaurenoic acid with a KAH enzyme can result in production of steviol in vitro.

In some embodiments, a steviol glycoside or steviol glycoside precursor is produced by whole cell bioconversion. For whole cell bioconversion to occur, a host cell expressing one or more enzymes involved in the steviol glycoside pathway takes up and modifies a steviol glycoside precursor in the cell; following modification in vivo, a steviol glycoside remains in the cell and/or is excreted into the culture medium. For example, a host cell expressing a gene encoding a UGT polypeptide can take up steviol and glycosylate steviol in the cell; following glycosylation in vivo, a steviol glycoside can be excreted into the culture medium. In some embodiments, the cell is permeabilized to take up a substrate to be modified or to excrete a modified product.

In some embodiments, a steviol glycoside or steviol glycoside precursor composition produced in vivo, in vitro, or by whole cell bioconversion comprises less contaminants than a Stevia extract from, inter alia, a Stevia plant. Contaminants include plant-derived compounds that contribute to off-flavors. Potential contaminants include pigments, lipids, proteins, phenolics, saccharides, spathulenol and other sesquiterpenes, labdane diterpenes, monoterpenes, decanoic acid, 8,11,14-eicosatrienoic acid, 2-methyloctadecane, pentacosane, octacosane, tetracosane, octadecanol, stigmasterol, β-sitosterol, α- and β-amyrin, lupeol, β-amryin acetate, pentacyclic triterpenes, centauredin, quercitin, epi-alpha-cadinol, carophylienes and derivatives, beta-pinene, beta-sitosterol, and gibberellin.

As used herein, the terms "detectable amount," "detectable concentration," "measurable amount," and "measurable concentration" refer to a level of steviol glycosides measured in AUC, $\mu M/OD_{600}$, mg/L, $\mu M$, or mM. Steviol glycoside production (i.e., total, supernatant, and/or intracellular steviol glycoside levels) can be detected and/or analyzed by techniques generally available to one skilled in the art, for example, but not limited to, liquid chromatography-mass spectrometry (LC-MS), thin layer chromatography (TLC), high-performance liquid chromatography (HPLC), ultraviolet-visible spectroscopy/spectrophotometry (UV-Vis), mass spectrometry (MS), and nuclear magnetic resonance spectroscopy (NMR).

As used herein, the terms "or" and "and/or" is utilized to describe multiple components in combination or exclusive of one another. For example, "x, y, and/or z" can refer to "x" alone, "y" alone, "z" alone, "x, y, and z," "(x and y) or z," "x or (y and z)," or "x or y or z." In some embodiments, "and/or" is used to refer to the exogenous nucleic acids that a recombinant cell comprises, wherein a recombinant cell comprises one or more exogenous nucleic acids selected from a group. In some embodiments, "and/or" is used to refer to production of steviol glycosides and/or steviol glycoside precursors. In some embodiments, "and/or" is used to refer to production of steviol glycosides, wherein one or more steviol glycosides are produced. In some embodiments, "and/or" is used to refer to production of steviol glycosides, wherein one or more steviol glycosides are produced through one or more of the following steps: culturing a recombinant microorganism, synthesizing one or more steviol glycosides in a recombinant microorganism, and/or isolating one or more steviol glycosides.

Transporters and Transcription Factor Expression

This document describes reagents and methods that can be used to efficiently produce steviol glycoside compositions. Modification of transport systems in a recombinant host that are involved in transport of steviol glycosides into culture medium can allow more effective production of steviol glycosides in recombinant hosts.

As set forth herein, recombinant cells having modifications to cellular transport are capable of producing steviol. Recombinant hosts described herein can produce steviol and have altered expression of at least one endogenous transporter gene. Recombinant hosts described herein can produce steviol and have altered expression of a transcription factor that regulates expression of at least one endogenous transporter gene. Altering expression of endogenous transporter genes can be useful for increasing production of steviol and/or excretion of steviol into the culture medium.

As set forth herein, recombinant cells having modifications to cellular transport are capable of producing at least one steviol glycoside, including, but not limited to, RebA, RebB, RebD, and/or RebM. Recombinant hosts described herein can produce at least one steviol glycoside such as RebA, RebB, RebD, and/or RebM and have altered expression of at least one endogenous transporter gene. Recombinant hosts described herein can produce at least one steviol glycoside such as RebA, RebB, RebD, and/or RebM and have altered expression of a transcription factor that regulates expression of at least one endogenous transporter gene. Recombinant hosts described herein can produce at least one steviol glycoside such as RebA, RebB, RebD, and/or RebM and have altered expression of a plurality of endogenous transporter genes and/or of a plurality of transcription factor genes that regulate expression of a plurality of endogenous transporter genes. Altering expression of endogenous transporter genes and/or transcription factors regulating expression of at least one transporter gene can be useful for increasing production of steviol glycosides and/or excretion of steviol glycosides into the culture medium.

Recombinant hosts disclosed herein can include one or more biosynthesis genes, such as one or more genes encoding a sucrose transporter and a sucrose synthase; a gene encoding a geranylgeranyl diphosphate synthase (GGPPS) polypeptide; a gene encoding an ent-copalyl diphosphate synthase (CDPS) polypeptide; a gene encoding a kaurene synthase (KS) polypeptide; a gene encoding a kaurene oxidase (KO) polypeptide; a gene encoding a steviol synthase (KAH) polypeptide; a gene encoding a cytochrome P450 reductase (CPR) polypeptide; a gene encoding a UGT85C2 polypeptide; a gene encoding a UGT76G1 polypeptide; a gene encoding a UGT74G1 polypeptide; a gene encoding a UGT91D2 functional homolog; and/or a gene encoding a EUGT11 polypeptide; wherein expression of one or more of these genes results in production of steviol steviol glycosides such as RebA, RebB, RebD, and/or RebM.

As used herein, the terms "transport of a steviol glycoside," "steviol glycoside transport," "excretion of a steviol glycoside," and "steviol glycoside excretion" can be used interchangeably.

As used herein, the term "transporter" (also referred to as a membrane transport protein) refers to a membrane protein involved in the movement of small molecules, macromolecules (such as carbohydrates), and ions across a biological membrane. Transporters span the membrane in which they are localized and across which they transport substances. Transporter proteins can assist in the movement (i.e., transport or excretion) of a substance from the intracellular space to the culture medium. Transporters are known to function as passive transport systems, carrying molecules down their concentration gradient, or as active transport systems, using energy to carry molecules uphill against their concentration gradient. Active transport is mediated by carriers which couple transport directly to the use of energy derived from hydrolysis of an ATP molecule or by carriers which make use of a pre-established electrochemical ion gradient to drive co-transport of the nutrient molecule and a co-transported ion. The latter category comprises symporters and antiporters, which carry the ion in the same or opposite direction, respectively, as the transported substrate.

Transport proteins have been classified according to various criteria at the Transporter Classification Database (on the world wide web at tcdb.org). See, Saier Jr. et al., Nucl. Acids Res., 42(1):D251-258 (2014). Non-limiting examples thereof include, among others, the family of Multiple Drug Resistance (MDR) plasma membrane transporters that is thought to be ubiquitous among living organisms. The MDR transporter superfamily can be further subdivided according to the mode of operation by which the substrate is transported from one side of the membrane to the other. Transporters can operate to move substances across membranes in response to chemiosmotic ion gradients or by active transport. ATP-binding cassette transporters (ABC transporters) are transmembrane proteins that utilize the energy of adenosine triphosphate (ATP) hydrolysis to carry out translocation of various substrates across membranes. They can transport a wide variety of substrates across the plasma membrane and intracellular membranes, including metabolic products, lipids and sterols, and drugs. Particular non-limiting examples of endogenous ABC transporter genes include PDR5, YDR061W, PDR15, SNQ2, YOR1, YOL075C, MDL2, ADP1, CAF16, VMR1 and STE6 (or a functional homolog thereof). In some aspects, ABC transporters transport steviol glycosides.

A second group of MDRs is further subdivided based on the nature of the chemiosmotic gradient that facilitates the transport. Saier, Jr. et al., J. Mol. Microbiol. Biotechnol. 1:257-279 (1999). In some aspects, MDR transporters transport steviol glycosides.

Another transporter family, the Major Facilitator Superfamily (MFS) transporters are monomeric polypeptides that can transport small solutes in response to proton gradients. The MFS transporter family is sometimes referred to as the uniporter-symporter-antiporter family. MFS transporters function in, inter alia, in sugar uptake and drug efflux systems. MFS transporters typically comprise conserved MFS-specific motifs. Non-limiting examples of endogenous MFS transporter genes include DTR1, SEO1, YBR241C, VBA3, FEN2, SNF3, STL1, HXT10, AZR1, MPH3, VBA5, GEX2, SNQ1, AQR1, MCH1, MCH5, ATG22, HXT15, MPH2, ITR1, SIT1, VPS73, HXT5, QDR1, QDR2, QDR3, SOA1, HXT9, YMR279C, YIL166C, HOL1, ENB1, TPO4 and FLR1 (or a functional homolog thereof). In some aspects, MFS transporters transport steviol glycosides.

Other transporter families include the SMR (small multidrug resistant) family, RND (Resistance-Nodulation-Cell Division) family, and the MATE (multidrug and toxic compound extrusion) family. The SMR family members are integral membrane proteins characterized by four alpha-helical transmembrane strands that confer resistance to a broad range of antiseptics, lipophilic quaternary ammonium compounds (QAC), and aminoglycoside resistance in bacteria. See, Bay & Turner, 2009, BMC Evol Biol., 9:140. In some aspects, SMR transporters transport steviol glycosides.

The MATE family members comprise 12 transmembrane (TM) domains. Members of the MATE family have been identified in prokaryotes, yeast such as *S. cerevisiae* and *Schizosaccharomyces pombe*, and plants. See Diener et al., 2001, Plant Cell. 13(7):1625-8. The MATE family members are sodium or proton antiporters. In some aspects, MATE transporters transport steviol glycosides.

Additional transporter families include the amino acid/auxin permease (AAAP) family (for example, YKL146W/AVT3, YBL089W/AVT5, YER119C/AVT6 and YIL088C/AVT7), the ATPase family (for example, YBL099W/ATP1, YDL185W/VMA1, YLR447C/VMA6, YOL077W/ATP19, YPL078C/ATP4, YEL027W/VMA3, YKL016C/ATP7, and YOR332W/VMA4), the sulfate permease (SulP) family (for example, YBR294W/SUL1, YGR125W and YPR003C), the lysosomal cystine transporter (LCT) family (for example, YCR075C/ERS1), the Ca2+:cation antiporter (CaCA) family (for example, YDL128W/VCX1 and YJR106W/ECM27), the amino acid-polyamine-organocation (APC) superfamily (for example, YDL210W/UGA4, YOL020W/TAT2, YPL274W/SAM3, YNL268W/LYP1, YHL036W/MUP3, YKR039W/GAP1 and YOR348C/PUT4), multidrug/oligosaccharidyl-lipid/polysaccharide (MOP) (for example, YDR338C), the ZRT/IRT-like protein (ZIP) metal transporter family (for example, YGL225W/ZRT1 and YOR079C/ATX2), the mitochondrial protein translocase (MPT) family (for example, YGR181W/TIM13, YNL070W/TOM7, YNL121C/TOM70, the voltage-gated ion channel (VIC) family (for example, YGR217W/CCH1 and YJL093C/TOK1), the monovalent cation:proton antiporter-2 (CPA2) family (for example, YJL094C/KHA1), the ThrE family of putative transmembrane amino acid efflux transporters (for example, YJL108C/PRM10), the oligopeptide transporter (OPT) family (for example, YJL212C/OPT1 and YGL114W), the K$^+$ transporter (Trk) family (for example, TKR050W/TRK2), the bile acid:Na symporter (BASS) family (for example, YMR034C), the drug/metabolite transporter (DMT) superfamily (for example, YMR253C, YML038C/YMD8, and YOR307C/SLY41), the mitochondrial carrier (MC) family (for example, YMR056C/AAC1, YNL083W/SAL1, YOR130C/ORT1, YOR222W/ODC2, YPR011C, YPR058W/YMC1, YPR128C/ANT1, YEL006W/YEA6, YER053C/PIC2, YFR045W, YGR257C/MTM1, YHR002W/LEU5, YIL006W/YIA6, YJL133W/MRS3, YKL120W/OAC1, YMR166C, YNL003C/PET8 and YOR100C/CRC1), the auxin efflux carrier (AEC) family (for example, YNL095C, YOR092W/ECM3 and YBR287W), the ammonia channel transporter (Amt) family (for example, YNL142W/MEP2), the metal ion (Mn$^{2+}$-iron) transporter (Nramp) family (for example, YOL122C/SMF1), the transient receptor potential Ca$^{2+}$ channel (TRP-CC) family (for example, YOR087W/YVC1), the arsenical resistance-3 (ACR3) family (for example, YPR201W/ARR3), the nucleobase:cation symporter-1 (NCS1) family (for example, YBR021W/FUR4), the inorganic phosphate transporter (PiT) family (for example, YBR296C/PHO089), the arsenite-antimonite (ArsAB) efflux family (for example, YDL100C/GET3), the IISP family of transporters, the glycerol uptake (GUP) family (for example, YGL084C/GUP1), the metal ion transport (MIT) family (for example, YKL064W/MNR2, YKL050C and YOR334W/MRS2), the copper transport (Ctr) family (for example, YLR411W/CTR3) and the cation diffusion facilitator (CDF) family (for example, YOR316C/COT1). Particular members of any of these transporter families are included within the scope of the disclosed invention to the extent that altered expression in a cell capable of producing steviol glycoside increases production of said steviol glycoside from the cell; exemplary members are disclosed above and in Tables 5, 6, and 14.

As used herein, the term "transcription factor" refers to a DNA-binding protein that regulates gene expression. Preferably, the transcription factor regulates expression of at least one transporter gene.

Methods for identifying a gene affecting production or transport of steviol glycosides and steviol glycoside pathway intermediates are disclosed herein. Such methods can involve inactivating at least one endogenous transporter gene or modifying expression of at least one transporter gene. Typically, a library of mutant microorganisms is prepared, each mutant in the library having a different endogenous transporter gene inactivated. Methods of inactivating genes and determining their effect in a microorganisms are known to a person having ordinary skill in the art; additional methods are disclosed in WO 2014/122328, the disclosure of which is incorporated by reference in its entirety. The mutant microorganisms comprising one or more steviol glycoside pathway genes are cultured in a medium under conditions in which steviol or a steviol glycoside is synthesized, and the amount of total, supernatant, and/or intracellular steviol glycosides produced by the microorganism is measured (e.g., using LC-MS) as described herein.

The disclosure is directed to recombinant host cells in which expression of endogenous transporter or transcription factor genes is modified. In some embodiments, the transporter or transcription factor gene is endogenous to *S. cerevisiae*, including, but not limited to *S. cerevisiae* strain S288C. In some embodiments, expression of an endogenous transporter or transcription factor can be modified by replacing the endogenous promoter with a different promoter that results in increased expression of the transporter protein (e.g., at least a 5% increase in expression, such as at least a 10%, 15%, 20%, 25%, 30%, 35%, 40%, 45%, or 50%, 100%, 200% increase or more in expression). For example, an endogenous promoter can be replaced with a constitutive or inducible promoter that results in increased expression of the transporter. Homologous recombination can be used to replace the promoter of an endogenous gene with a different promoter that results in increased expression of the transporter. In other embodiments, the inducible or constitutive promoter and endogenous transporter or transcription factor can be integrated into another locus of the genome using homologous recombination. In other embodiments, the transporter or transcription factor gene can be introduced into a microorganism using exogenous plasmids with a promoter that results in overexpression of the transporter or transcription factor in the microorganism. In yet another embodiment, the exogenous plasmids may also comprise multiple copies of the transporter or transcription factor gene. In a further embodiment, the endogenous transporter or transcription factor can be induced to be overexpressed using native mechanisms to the recombinant microorganism (e.g. heat shock, stress, heavy metal, or antibiotic exposure). In yet a further embodiment, the activity of an endogenous gene product is enhanced or increased (for example, by mutation). In yet another embodiment, a homologous or orthologous gene of an endogenous yeast transporter or transcription factor gene is overexpressed.

In certain other embodiments, modified expression of a target gene in a recombinant microorganism comprises overexpressing a transporter gene and/or a transcription factor gene involved in expression of said transporter gene. In yet other embodiments, a plurality of endogenous transporter genes or transcription factor genes is overexpressed in said recombinant microorganism.

Modification of transcription factor expression can be used to increase transporter expression. For example, yeast transcriptions factor PDR1 regulates expression of the genes encoding ABC transporters PDR5, SNQ2 and YOR1. Therefore, in some embodiments, promoters for the endogenous PDR1 locus can be replaced with a different promoter that results in increased expression of the transcription factors, which can increase production of endogenous transporters.

In some embodiments, the transporter gene or transcription factor gene is (using Uniprot Ordered Locus Name for each): YAL067C, YBL089W, YBL099W, YBR008C, YBR021W, YBR043C, YBR180W, YBR241C, YBR287W, YBR294W, YBR295W, YBR296C, YCL038C, YCL069W, YCR011C, YCR028C, YCR075C, YDL054C, YDL100C, YDL128W, YDL185W, YDL194W, YDL210W, YDL245C, YDL247W, YDR011W, YDR061W, YDR093W, YDR292C, YDR338C, YDR406W, YDR497C, YDR536W, YEL006W, YEL027W, YEL031W, YEL065W, YER019C-A, YER053C, YER119C, YER166W, YFL011W, YFL028C, YFR045W, YGL006W, YGL013C, YGL084C, YGL104C, YGL114W, YGL167C, YGL255W, YGR125W, YGR181W, YGR217W, YGR224W, YGR257C, YGR281W, YHL016C, YHL035C, YHL036W, YHR002W, YHR096C, YIL006W, YIL088C, YIL120W, YIL121W, YIL166C, YJL093C, YJL094C, YJL108C, YJL133W, YJL212C, YJL219W, YJR106W, YJR160C, YKL016C, YKL050C, YKL064W, YKL120W, YKL146W, YKL209C, YKR039W, YKR050W, YKR105C, YKR106W, YLR411W, YLR447C, YML038C, YML116W, YMR034C, YMR056C, YMR166C, YMR253C, YMR279C, YNL003C, YNL065W, YNL070W, YNL083W, YNL095C, YNL121C, YNL142W, YNL268W, YNR055C, YOL020W, YOL075C, YOL077W-A, YOL122C, YOL158C, YOR079C, YOR087W, YOR092W, YOR100C, YOR130C, YOR153W, YOR222W, YOR271C, YOR273C, YOR291W, YOR306C, YOR307C, YOR316C, YOR332W, YOR334W, YOR348C, YPL036W, YPL078C, YPL270W, YPL274W, YPR003C, YPR011C, YPR058W, YPR128C, and/or YPR201W. SEQ ID NOs, Uniprot Accession Numbers, and gene names for each Ordered Locus can be found in Tables 5, 6, and 14. In some embodiments, the above transporter genes and transcription factor genes regulate excretion of steviol glycosides.

In some embodiments, deletion in a steviol glycoside-producing strain of YDL128W (SEQ ID NO:22), YDL194W (SEQ ID NO:24), YDL210W (SEQ ID NO:25), YDR536W (SEQ ID NO:30), YFL011W (SEQ ID NO:33), YGL006W (SEQ ID NO:34), YGL013C (SEQ ID NO:35), YGL255W (SEQ ID NO:36), YGR181W (SEQ ID NO:38), YGR217W (SEQ ID NO:39), YHL016C (SEQ ID NO:42), YIL088C (SEQ ID NO:43), YJL094C (SEQ ID NO:45), YJR106W (SEQ ID NO:48), YKR050W (SEQ ID NO:51), YNL065W (SEQ ID NO:59), YNL083W (SEQ ID NO:61), YNL121C (SEQ ID NO:63), YNL142W (SEQ ID NO:64), YOR291W (SEQ ID NO:74), YOR306C (SEQ ID NO:75), YOR334W (SEQ ID NO:77), YPL270W (SEQ ID NO:79), YPR011C (SEQ ID NO:82), YPR128C (SEQ ID NO:84) results in a measurable decrease of RebD excreted into the culture medium, indicating that each plays a role in RebD excretion. See Example 3 and Tables 7-10.

In some embodiments, deletion in a steviol glycoside-producing strain of YBR180W (SEQ ID NO:13), YAL067C (SEQ ID NO:14), YBR241C (SEQ ID NO:17), YCL069W (SEQ ID NO:19), YCR075C (SEQ ID NO:21), YDL128W (SEQ ID NO:22), YDL194W (SEQ ID NO:24), YDR093W (SEQ ID NO:27), YDR338C (SEQ ID NO:28), YDR406W (SEQ ID NO:29), YER166W (SEQ ID NO:32), YFL011W (SEQ ID NO:33), YGL006W (SEQ ID NO:34), YGL013C (SEQ ID NO:35), YGL255W (SEQ ID NO:36), YGR217W (SEQ ID NO:39), YHL016C (SEQ ID NO:42), YJL094C (SEQ ID NO:45), YJL212C (SEQ ID NO:47), YJR106W (SEQ ID NO:48), YJR160C (SEQ ID NO:49), YKR050W (SEQ ID NO:51), YKR106W (SEQ ID NO:53), YML116W (SEQ ID NO:55), YMR034C (SEQ ID NO:56), YMR056C (SEQ ID NO:57), YMR253C (SEQ ID NO:58), YNL070W (SEQ ID NO:60), YNL083W (SEQ ID NO:61), YNL095C (SEQ ID NO:62), YNL121C (SEQ ID NO:63), YOL075C (SEQ ID NO:66), YOL122C (SEQ ID NO:68), YOR087W (SEQ ID NO:70), YOR222W (SEQ ID NO:73), YOR291W (SEQ ID NO:74), YOR306C (SEQ ID NO:75), YPL274W (SEQ ID NO:80), YPR003C (SEQ ID NO:81), YPR011C (SEQ ID NO:82), or YPR201W (SEQ ID NO:85) results in a measurable decrease of RebM, indicating that each plays a role in RebM excretion. See Example 3 and Tables 7-10.

Figure 2:
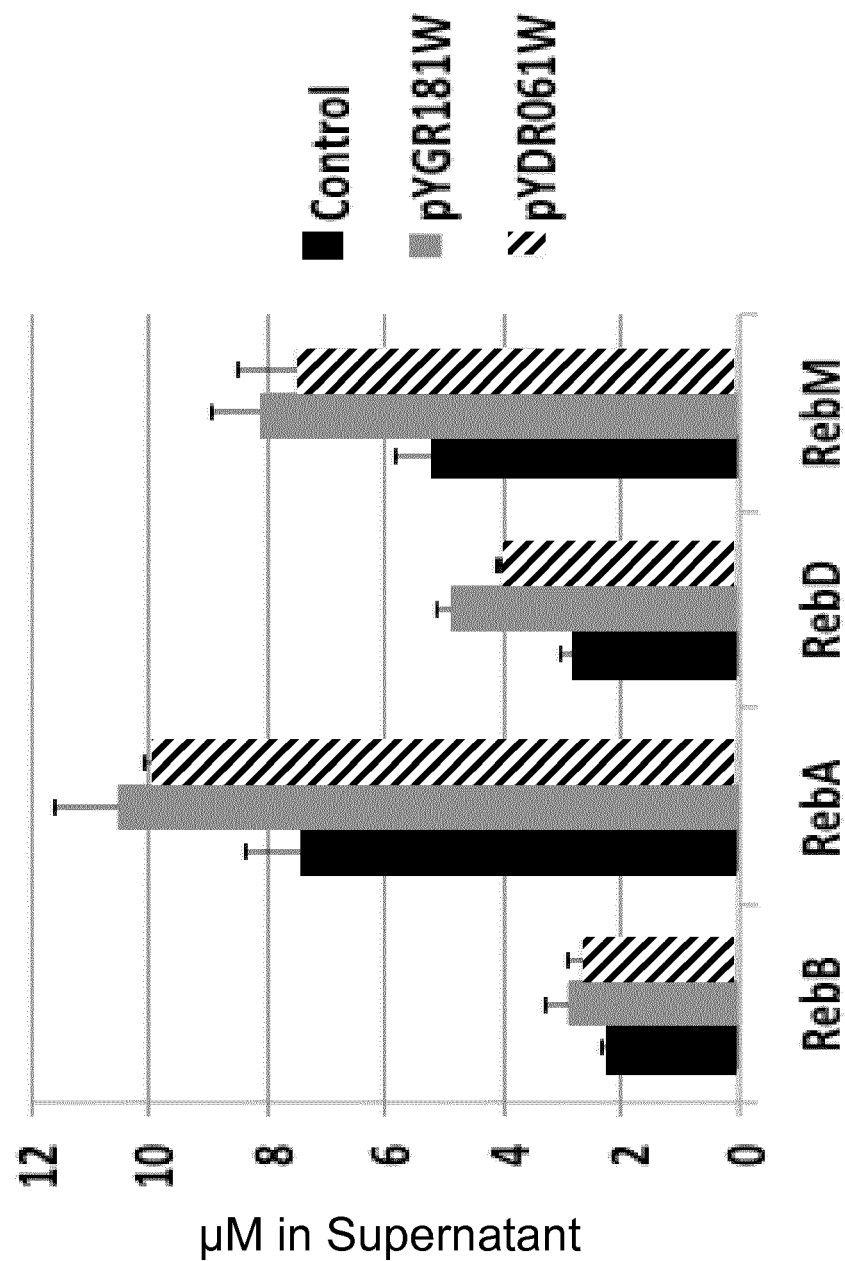
FIG. 2 is a bar graph of the amount (μM) of RebA, RebB, RebD, or RebM in the supernatant of a steviol glycoside-producing strain overexpressing transporter genes YGR181W (SEQ ID NO:38) or YDR061W (SEQ ID NO:26), compared to a control steviol glycoside-producing strain. See Example 4.

In some embodiments, overexpression of YGR181W (SEQ ID NO:38) or YDR061W (SEQ ID NO:26) improves RebD and RebM transport into the culture medium by approximately 2-fold (~400-500 mg/L of supernatant RebD and RebM in YGR181W (SEQ ID NO:38) and YDR061W (SEQ ID NO:26) overexpression strains versus ~250 mg/L of supernatant RebD and RebM in a control steviol glycoside-producing strain). See Example 4, FIG. 2, and FIG. 3.

In some embodiments, overexpression of a transporter of Table 11 increases excretion of RebA, RebB, RebD, and/or RebM by at least 20%. In some embodiments, overexpression of a transporter of Table 12 increases production of RebA, RebB, RebD, and/or RebM by at least 40%. See Example 5.

In some embodiments, a transporter gene is integrated into the genome of a steviol glycoside-producing host. In some embodiments, the integrated transporter is YBR043C (SEQ ID NO:88), YEL027W (SEQ ID NO:102), YJL093C (SEQ ID NO:44), YJR106W (SEQ ID NO:48), YMR166C (SEQ ID NO:132), YIL166C (SEQ ID NO:121), YKL120W (SEQ ID NO:126), YDL054C (SEQ ID NO:94), YDL128W (SEQ ID NO:22), YDR536W (SEQ ID NO:30), YGL167C (SEQ ID NO:112), YKL146W (SEQ ID NO:127), YKR039W (SEQ ID NO:129), YOL122C (SEQ ID NO:68), or YPR011C (SEQ ID NO:82). In some embodiments, integration of YBR043C (SEQ ID NO:88), YEL027W (SEQ ID NO:102), YJL093C (SEQ ID NO:44), YJR106W (SEQ ID NO:48), YKL120W (SEQ ID NO:126), or YMR166C (SEQ ID NO:132) improves excretion and/or total production of 13-SMG. In some embodiments, integration of YBR043C (SEQ ID NO:88), YEL027W (SEQ ID NO:102), or YMR166C (SEQ ID NO:132) improves excretion and/or total production of RebA. In some embodiments, integration of YBR043C (SEQ ID NO:88), YEL027W (SEQ ID NO:102), or YMR166C (SEQ ID NO:132) improves excretion and/or total production of RebB. In some embodiments, integration of YBR043C of SEQ ID NO:88, YEL027W of SEQ ID NO:102, YJL093C of SEQ ID NO:44, YJR106W of SEQ ID NO:48, and YMR166C of SEQ ID NO:132 improves excretion and/or total production of RebD, and YBR043C of SEQ ID NO:88, YEL027W of SEQ ID NO:102, YIL166C (SEQ ID NO:121), YJL093C of SEQ ID NO:44, YJR106W of SEQ ID NO:48, and YMR166C of SEQ ID NO:132 improves excretion and/or total production of RebM, as measured by an increase in RebD and RebM levels in the supernatant compared to a control steviol glycoside-producing strain. See Example 6.

In some embodiments, steviol glycoside-producing S. cerevisiae strains overexpressing YJL093C (SEQ ID NO:44) or YBR043C (SEQ ID NO:88) produce higher levels of RebD+RebM, compared to a steviol glycoside-producing S. cerevisiae strain that does not overexpress YJL093C or YBR043C. See Example 7.

In some embodiments, a transporter that is knocked out can also have specificity for transport of larger molecular weight steviol glycosides (for example, RebD and the knockout of YGR181W of SEQ ID NO:38 or YOR291W of SEQ ID NO:74), and therefore, can be useful to overexpress in strains where transport of RebD into the culture medium is desired. With appropriate balancing of the rate of glycosylation activity through expression of pathway UGTs, smaller molecular weight steviol glycosides are further glycosylated before they are transported into the culture medium. For example, higher expression levels of a UGT76G1 and UGT91D2e and/or EUGT11, as compared to the UGT74G1 and UGT85C2 enzymes, can prevent accumulation of the steviol monoglucosides that are transported more readily. If the UGT activity level is higher (so the glycosylation rate is faster) than the rate of transport, then greater amounts of larger molecular weight steviol glycosides will be produced.

Steviol and Steviol Glycoside Biosynthesis Nucleic Acids

A recombinant gene encoding a polypeptide described herein comprises the coding sequence for that polypeptide, operably linked in sense orientation to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence. Typically, the translation initiation site of the translational reading frame of the coding sequence is positioned between one and about fifty nucleotides downstream of the regulatory region for a monocistronic gene.

In many cases, the coding sequence for a polypeptide described herein is identified in a species other than the recombinant host, i.e., is a heterologous nucleic acid. Thus, if the recombinant host is a microorganism, the coding sequence can be from other prokaryotic or eukaryotic microorganisms, from plants or from animals. In some case, however, the coding sequence is a sequence that is native to the host and is being reintroduced into that organism. A native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. "Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). A regulatory region is operably linked to a coding sequence by positioning the regulatory region and the coding sequence so that the regulatory region is effective for regulating transcription or translation of the sequence. For example, to operably link a coding sequence and a promoter sequence, the translation initiation site of the translational reading frame of the coding sequence is typically positioned between one and about fifty nucleotides downstream of the promoter. A regulatory region can, however, be positioned as much as about 5,000 nucleotides upstream of the translation initiation site, or about 2,000 nucleotides upstream of the transcription start site.

The choice of regulatory regions to be included depends upon several factors, including, but not limited to, efficiency, selectability, inducibility, desired expression level, and preferential expression during certain culture stages. It is a routine matter for one of skill in the art to modulate the expression of a coding sequence by appropriately selecting and positioning regulatory regions relative to the coding sequence. It will be understood that more than one regulatory region may be present, e.g., introns, enhancers, upstream activation regions, transcription terminators, and inducible elements.

One or more genes can be combined in a recombinant nucleic acid construct in "modules" useful for a discrete aspect of steviol and/or steviol glycoside production. Combining a plurality of genes in a module, particularly a polycistronic module, facilitates the use of the module in a variety of species. For example, a steviol biosynthesis gene cluster, or a UGT gene cluster, can be combined in a polycistronic module such that, after insertion of a suitable regulatory region, the module can be introduced into a wide variety of species. As another example, a UGT gene cluster can be combined such that each UGT coding sequence is operably linked to a separate regulatory region, to form a UGT module. Such a module can be used in those species for which monocistronic expression is necessary or desirable. In addition to genes useful for steviol or steviol glycoside production, a recombinant construct typically also comprises an origin of replication, and one or more selectable markers for maintenance of the construct in appropriate species.

It will be appreciated that because of the degeneracy of the genetic code, a number of nucleic acids can encode a particular polypeptide; i.e., for many amino acids, there is more than one nucleotide triplet that serves as the codon for the amino acid. Thus, codons in the coding sequence for a given polypeptide can be modified such that optimal expression in a particular host is obtained, using appropriate codon bias tables for that host (e.g., microorganism). As isolated nucleic acids, these modified sequences can exist as purified molecules and can be incorporated into a vector or a virus for use in constructing modules for recombinant nucleic acid constructs.

In some cases, it is desirable to inhibit one or more functions of an endogenous polypeptide in order to divert metabolic intermediates towards steviol or steviol glycoside biosynthesis. For example, it may be desirable to downregulate synthesis of sterols in a strain in order to further increase steviol or steviol glycoside production, e.g., by downregulating squalene epoxidase. As another example, it may be desirable to inhibit degradative functions of certain endogenous gene products, e.g., glycohydrolases that remove glucose moieties from secondary metabolites or phosphatases as discussed herein. As another example, expression of membrane transporters involved in transport of steviol glycosides can be activated, such that transportation of steviol glycosides is increased. Such regulation can be beneficial in that transportation of steviol glycosides can be increased for a desired period of time during culture of the microorganism, thereby increasing the yield of glycoside product(s) at harvest. In such cases, a nucleic acid that overexpresses the polypeptide or gene product may be included in a recombinant construct that is transformed into the strain. Alternatively, mutagenesis can be used to generate mutants in genes for which it is desired to increase or enhance function.

Recombinant Hosts

Recombinant hosts can be used to express polypeptides for the producing steviol glycosides, including mammalian, insect, plant, and algal cells. A number of prokaryotes and eukaryotes are also suitable for use in constructing the recombinant microorganisms described herein, e.g., gram-negative bacteria, yeast, and fungi. A species and strain selected for use as a steviol glycoside production strain is first analyzed to determine which production genes are endogenous to the strain and which genes are not present. Genes for which an endogenous counterpart is not present in the strain are advantageously assembled in one or more recombinant constructs, which are then transformed into the strain in order to supply the missing function(s).

Typically, the recombinant microorganism is grown in a fermenter at a defined temperature(s) for a desired period of time. The constructed and genetically engineered microorganisms provided by the invention can be cultivated using conventional fermentation processes, including, inter alia, chemostat, batch, fed-batch cultivations, semi-continuous fermentations such as draw and fill, continuous perfusion fermentation, and continuous perfusion cell culture. Depending on the particular microorganism used in the method, other recombinant genes such as isopentenyl biosynthesis genes and terpene synthase and cyclase genes may also be present and expressed. Levels of substrates and intermediates, e.g., isopentenyl diphosphate, dimethylallyl diphosphate, GGPP, kaurene and kaurenoic acid, can be determined by extracting samples from culture media for analysis according to published methods.

Carbon sources of use in the instant method include any molecule that can be metabolized by the recombinant host cell to facilitate growth and/or production of the steviol glycosides. Examples of suitable carbon sources include, but are not limited to, sucrose (e.g., as found in molasses), fructose, xylose, ethanol, glycerol, glucose, cellulose, starch, cellobiose or other glucose-comprising polymer. In embodiments employing yeast as a host, for example, carbon sources such as sucrose, fructose, xylose, ethanol, glycerol, and glucose are suitable. The carbon source can be provided to the host organism throughout the cultivation period or alternatively, the organism can be grown for a period of time in the presence of another energy source, e.g., protein, and then provided with a source of carbon only during the fed-batch phase.

After the recombinant microorganism has been grown in culture for the desired period of time, steviol and/or one or more steviol glycosides can then be recovered from the culture using various techniques known in the art. In some embodiments, a permeabilizing agent can be added to aid the feedstock entering into the host and product getting out. For example, a crude lysate of the cultured microorganism can be centrifuged to obtain a supernatant. The resulting supernatant can then be applied to a chromatography column, e.g., a C-18 column, and washed with water to remove hydrophilic compounds, followed by elution of the compound(s) of interest with a solvent such as methanol. The compound(s) can then be further purified by preparative HPLC. See also, WO 2009/140394.

It will be appreciated that the various genes and modules discussed herein can be present in two or more recombinant hosts rather than a single host. When a plurality of recombinant hosts is used, they can be grown in a mixed culture to produce steviol and/or steviol glycosides.

Alternatively, the two or more hosts each can be grown in a separate culture medium and the product of the first culture medium, e.g., steviol, can be introduced into second culture medium to be converted into a subsequent intermediate, or into an end product such as, for example, RebA. The product produced by the second, or final host is then recovered. It will also be appreciated that in some embodiments, a recombinant host is grown using nutrient sources other than a culture medium and utilizing a system other than a fermenter.

Exemplary prokaryotic and eukaryotic species are described in more detail below. However, it will be appreciated that other species can be suitable. For example, suitable species can be in a genus such as *Agaricus, Aspergillus, Bacillus, Candida, Corynebacterium, Eremothecium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* or *Yarrowia*. Exemplary species from such genera include *Lentinus tigrinus, Laetiporus sulphureus, Phanerochaete chrysosporium, Pichia pastoris, Cyberlindnera jadinii, Physcomitrella patens, Rhodoturula glutinis, Rhodoturula mucilaginosa, Phaffia rhodozyma, Xanthophyllomyces dendrorhous, Fusarium fujikuroi/Gibberella fujikuroi, Candida utilis, Candida glabrata, Candida albicans,* and *Yarrowia lipolytica*.

In some embodiments, a microorganism can be a prokaryote such as *Escherichia coli*.

In some embodiments, a microorganism can be an Ascomycete such as *Gibberella fujikuroi, Kluyveromyces lactis, Schizosaccharomyces pombe, Aspergillus niger, Yarrowia lipolytica, Ashbya gossypii,* or *S. cerevisiae*.

In some embodiments, a microorganism can be an algal cell such as *Blakeslea trispora, Dunaliella salina, Haematococcus pluvialis, Chlorella* sp., *Undaria pinnatifida, Sargassum, Laminaria japonica, Scenedesmus almeriensis* species.

In some embodiments, a microorganism can be a cyanobacterial cell such as *Blakeslea trispora, Dunaliella salina, Haematococcus pluvialis, Chlorella* sp., *Undaria pinnatifida, Sargassum, Laminaria japonica, Scenedesmus almeriensis*.

*Saccharomyces* spp.

*Saccharomyces* is a widely used chassis organism in synthetic biology, and can be used as the recombinant microorganism platform. For example, there are libraries of mutants, plasmids, detailed computer models of metabolism and other information available for *S. cerevisiae*, allowing for rational design of various modules to enhance product yield. Methods are known for making recombinant microorganisms.

*Aspergillus* spp.

*Aspergillus* species such as *A. oryzae, A. niger* and *A. sojae* are widely used microorganisms in food production and can also be used as the recombinant microorganism platform. Nucleotide sequences are available for genomes of *A. nidulans, A. fumigatus, A. oryzae, A. clavatus, A. flavus, A. niger,* and *A. terreus*, allowing rational design and modification of endogenous pathways to enhance flux and increase product yield. Metabolic models have been developed for *Aspergillus*, as well as transcriptomic studies and proteomics studies. *A. niger* is cultured for the industrial production of a number of food ingredients such as citric acid and gluconic acid, and thus species such as *A. niger* are generally suitable for producing steviol glycosides.

*E. coli*

*E. coli*, another widely used platform organism in synthetic biology, can also be used as the recombinant microorganism platform. Similar to *Saccharomyces*, there are libraries of mutants, plasmids, detailed computer models of metabolism and other information available for *E. coli*, allowing for rational design of various modules to enhance product yield. Methods similar to those described above for *Saccharomyces* can be used to make recombinant *E. coli* microorganisms.

*Agaricus, Gibberella,* and *Phanerochaete* spp.

*Agaricus, Gibberella,* and *Phanerochaete* spp. can be useful because they are known to produce large amounts of isoprenoids in culture. Thus, the terpene precursors for producing large amounts of steviol glycosides are already produced by endogenous genes. Thus, modules comprising recombinant genes for steviol glycoside biosynthesis polypeptides can be introduced into species from such genera without the necessity of introducing mevalonate or MEP pathway genes.

*Arxula adeninivorans (Blastobotrys adeninivorans)*

*Arxula adeninivorans* is dimorphic yeast (it grows as budding yeast like the baker's yeast up to a temperature of 42° C., above this threshold it grows in a filamentous form) with unusual biochemical characteristics. It can grow on a wide range of substrates and can assimilate nitrate. It has successfully been applied to the generation of strains that can produce natural plastics or the development of a biosensor for estrogens in environmental samples.

*Yarrowia lipolytica*

*Yarrowia lipolytica* is dimorphic yeast (see *Arxula adeninivorans*) and belongs to the family Hemiascomycetes. The entire genome of *Yarrowia lipolytica* is known. *Yarrowia* species is aerobic and considered to be non-pathogenic. *Yarrowia* is efficient in using hydrophobic substrates (e.g. alkanes, fatty acids, oils) and can grow on sugars. It has a high potential for industrial applications and is an oleaginous microorganism. *Yarrowia lipolytica* can accumulate lipid content to approximately 40% of its dry cell weight and is a model organism for lipid accumulation and remobilization. See e.g., Nicaud, 2012, *Yeast* 29(10):409-18; Beopoulos et al., 2009, *Biohimie* 91(6):692-6; Bankar et al., 2009, *Appl Microbiol Biotechnol.* 84(5):847-65.

*Rhodotorula* sp.

*Rhodotorula* is unicellular, pigmented yeast. The oleaginous red yeast, *Rhodotorula glutinis*, has been shown to produce lipids and carotenoids from crude glycerol (Saenge et al., 2011, *Process Biochemistry* 46(1):210-8). *Rhodotorula toruloides* strains have been shown to be an efficient fed-batch fermentation system for improved biomass and lipid productivity (Li et al., 2007, *Enzyme and Microbial Technology* 41:312-7).

*Rhodosporidium toruloides*

*Rhodosporidium toruloides* is oleaginous yeast and useful for engineering lipid-production pathways (See e.g. Zhu et al., 2013, *Nature Commun.* 3:1112; Ageitos et al., 2011, *Applied Microbiology and Biotechnology* 90(4):1219-27).

*Candida boidinii*

*Candida boidinii* is methylotrophic yeast (it can grow on methanol). Like other methylotrophic species such as *Hansenula polymorpha* and *Pichia pastoris*, it provides an excellent platform for producing heterologous proteins. Yields in a multigram range of a secreted foreign protein have been reported. A computational method, IPRO, recently predicted mutations that experimentally switched the cofactor specificity of *Candida boidinii* xylose reductase from NADPH to NADH. See, e.g., Mattanovich et al., 2012, *Methods Mol Biol.* 824:329-58; Khoury et al., 2009, *Protein Sci.* 18(10):2125-38.

*Hansenula polymorpha* (*Pichia angusta*)

*Hansenula polymorpha* is methylotrophic yeast (see *Candida boidinii*). It can furthermore grow on a wide range of other substrates; it is thermo-tolerant and can assimilate nitrate (see also *Kluyveromyces lactis*). It has been applied to producing hepatitis B vaccines, insulin and interferon alpha-2a for the treatment of hepatitis C, furthermore to a range of technical enzymes. See, e.g., Xu et al., 2014, *Virol Sin.* 29(6):403-9.

*Kluyveromyces lactis*

*Kluyveromyces lactis* is yeast regularly applied to the production of kefir. It can grow on several sugars, most importantly on lactose which is present in milk and whey. It has successfully been applied among others for producing chymosin (an enzyme that is usually present in the stomach of calves) for producing cheese. Production takes place in fermenters on a 40,000 L scale. See, e.g., van Ooyen et al., 2006, *FEMS Yeast Res.* 6(3):381-92.

*Pichia pastoris*

*Pichia pastoris* is methylotrophic yeast (see *Candida boidinii* and *Hansenula polymorpha*). It provides an efficient platform for producing foreign proteins. Platform elements are available as a kit and it is worldwide used in academia for producing proteins. Strains have been engineered that can produce complex human N-glycan (yeast glycans are similar but not identical to those found in humans). See, e.g., Piirainen et al., 2014, *N Biotechnol.* 31(6):532-7.

*Physcomitrella* spp.

*Physcomitrella* mosses, when grown in suspension culture, have characteristics similar to yeast or other fungal cultures. This genera can be used for producing plant secondary metabolites, which can be difficult to produce in other types of cells.

Steviol Glycoside Compositions

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., RebD) and have a consistent taste profile. Thus, the recombinant hosts described herein can facilitate the production of compositions that are tailored to meet the sweetening profile desired for a given food product and that have a proportion of each steviol glycoside that is consistent from batch to batch. Hosts described herein do not produce the undesired plant by-products found in *Stevia* extracts. Thus, steviol glycoside compositions produced by the recombinant hosts described herein are distinguishable from compositions derived from *Stevia* plants.

The amount of an individual steviol glycoside (e.g., RebA, RebB, RebD, or RebM) produced can be from about 1 mg/L to about 2,800 mg/L, e.g., about 1 to about 10 mg/L, about 3 to about 10 mg/L, about 5 to about 20 mg/L, about 10 to about 50 mg/L, about 10 to about 100 mg/L, about 25 to about 500 mg/L, about 100 to about 1,500 mg/L, or about 200 to about 1,000 mg/L, at least about 1,000 mg/L, at least about 1,200 mg/L, at least about at least 1,400 mg/L, at least about 1,600 mg/L, at least about 1,800 mg/L, or at least about 2,800 mg/L. In some aspects, the amount of an individual steviol glycoside can exceed 2,800 mg/L. The amount of a combination of steviol glycosides (e.g., RebA, RebB, RebD, or RebM) produced can be from about 1 mg/L to about 6,000 mg/L, e.g., about 200 to about 1,500, at least about 2,000 mg/L, at least about 3,000 mg/L, at least about 4,000 mg/L, at least about 5,000 mg/L, or at least about 6,000 mg/L. In some aspects, the amount of a combination of steviol glycosides can exceed 6,000 mg/L. In general, longer culture times will lead to greater amounts of product. Thus, the recombinant microorganism can be cultured for from 1 day to 7 days, from 1 day to 5 days, from 3 days to 5 days, about 3 days, about 4 days, or about 5 days.

It will be appreciated that the various genes and modules discussed herein can be present in two or more recombinant microorganisms rather than a single microorganism. When a plurality of recombinant microorganisms is used, they can be grown in a mixed culture to produce steviol and/or steviol glycosides. For example, a first microorganism can comprise one or more biosynthesis genes for producing steviol and null mutations in a first group of endogenous transporters, while a second microorganism comprises steviol glycoside biosynthesis genes and null mutations in a second group of endogenous transporters. The product produced by the second, or final microorganism is then recovered. It will also be appreciated that in some embodiments, a recombinant microorganism is grown using nutrient sources other than a culture medium and utilizing a system other than a fermenter.

Alternatively, the two or more microorganisms each can be grown in a separate culture medium and the product of the first culture medium, e.g., steviol, can be introduced into second culture medium to be converted into a subsequent intermediate, or into an end product such as RebA. The product produced by the second, or final microorganism is then recovered. The microorganisms can have the same or a different group of mutations in endogenous transporters. It will also be appreciated that in some embodiments, a recombinant microorganism is grown using nutrient sources other than a culture medium and utilizing a system other than a fermenter.

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., RebD) and have a consistent taste profile. Thus, the recombinant microorganisms described herein can facilitate the production of compositions that are tailored to meet the sweetening profile desired for a given food product and that have a proportion of each steviol glycoside that is consistent from batch to batch. Microorganisms described herein do not produce the undesired plant byproducts found in *Stevia* extracts. Thus, steviol glycoside compositions produced by the recombinant microorganisms described herein are distinguishable from compositions derived from *Stevia* plants.

Steviol glycosides and compositions obtained by the methods disclosed herein can be used to make food products, dietary supplements and sweetener compositions. See, e.g., WO 2011/153378, WO 2013/022989, WO 2014/122227, and WO 2014/122328, each of which has been incorporated by reference in its entirety.

For example, substantially pure steviol or steviol glycoside such as RebM or RebD can be included in food products such as ice cream, carbonated beverages, fruit juices, yogurts, baked goods, chewing gums, hard and soft candies, and sauces. Substantially pure steviol or steviol glycoside can also be included in non-food products such as pharmaceutical products, medicinal products, dietary supplements and nutritional supplements. Substantially pure steviol or steviol glycosides may also be included in animal feed products for both the agriculture industry and the companion animal industry. Alternatively, a mixture of steviol and/or steviol glycosides can be made by culturing recombinant microorganisms separately, each producing a specific steviol or steviol glycoside, recovering the steviol or steviol glycoside in substantially pure form from each microorganism and then combining the compounds to obtain a mixture comprising each compound in the desired proportion. The recombinant microorganisms described herein permit more precise and consistent mixtures to be obtained compared to current Stevia products. For example, recombinant microorganisms described herein can express transporters specific for transport of a particular rebaudioside into the culture medium. When a transporter is specific for a particular rebaudioside it will enrich the concentration of that compound in the fermentation broth, preventing it from being further reacted to a different compound, and by selectively transporting the rebaudioside into the fermentation broth it will make it easier to recover from the other rebaudiosides and therefore making the process more efficient.

In another alternative, a substantially pure steviol or steviol glycoside can be incorporated into a food product along with other sweeteners, e.g. saccharin, dextrose, sucrose, fructose, erythritol, aspartame, sucralose, monatin, or acesulfame potassium. The weight ratio of steviol or steviol glycoside relative to other sweeteners can be varied as desired to achieve a satisfactory taste in the final food product. See, e.g., U.S. 2007/0128311. In some embodiments, the steviol or steviol glycoside may be provided with a flavor (e.g., citrus) as a flavor modulator.

Compositions produced by a recombinant microorganism described herein can be incorporated into food products. For example, a steviol glycoside composition produced by a recombinant microorganism can be incorporated into a food product in an amount ranging from about 20 mg steviol glycoside/kg food product to about 1800 mg steviol glycoside/kg food product on a dry weight basis, depending on the type of steviol glycoside and food product. For example, a steviol glycoside composition produced by a recombinant microorganism can be incorporated into a dessert, cold confectionary (e.g., ice cream), dairy product (e.g., yogurt), or beverage (e.g., a carbonated beverage) such that the food product has a maximum of 500 mg steviol glycoside/kg food on a dry weight basis. A steviol glycoside composition produced by a recombinant microorganism can be incorporated into a baked good (e.g., a biscuit) such that the food product has a maximum of 300 mg steviol glycoside/kg food on a dry weight basis. A steviol glycoside composition produced by a recombinant microorganism can be incorporated into a sauce (e.g., chocolate syrup) or vegetable product (e.g., pickles) such that the food product has a maximum of 1000 mg steviol glycoside/kg food on a dry weight basis. A steviol glycoside composition produced by a recombinant microorganism can be incorporated into a bread such that the food product has a maximum of 160 mg steviol glycoside/kg food on a dry weight basis. A steviol glycoside composition produced by a recombinant microorganism, plant, or plant cell can be incorporated into a hard or soft candy such that the food product has a maximum of 1600 mg steviol glycoside/kg food on a dry weight basis. A steviol glycoside composition produced by a recombinant microorganism, plant, or plant cell can be incorporated into a processed fruit product (e.g., fruit juices, fruit filling, jams, and jellies) such that the food product has a maximum of 1000 mg steviol glycoside/kg food on a dry weight basis.

For example, such a steviol glycoside composition can have from 90-99% RebA and an undetectable amount of Stevia plant-derived contaminants, and be incorporated into a food product at from 25-1600 mg/kg, e.g., 100-500 mg/kg, 25-100 mg/kg, 250-1000 mg/kg, 50-500 mg/kg or 500-1000 mg/kg on a dry weight basis.

Such a steviol glycoside composition can be a RebB-enriched composition having greater than 3% RebB and be incorporated into the food product such that the amount of RebB in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebB-enriched composition has an undetectable amount of Stevia plant-derived contaminants.

Such a steviol glycoside composition can be a RebD-enriched composition having greater than 3% RebD and be incorporated into the food product such that the amount of RebD in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebD-enriched composition has an undetectable amount of Stevia plant-derived contaminants.

Such a steviol glycoside composition can be a RebE-enriched composition having greater than 3% RebE and be incorporated into the food product such that the amount of RebE in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebE-enriched composition has an undetectable amount of Stevia plant-derived contaminants.

Such a steviol glycoside composition can be a RebM-enriched composition having greater than 3% RebM and be incorporated into the food product such that the amount of RebM in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebM-enriched composition has an undetectable amount of Stevia plant-derived contaminants.

In some embodiments, a substantially pure steviol or steviol glycoside is incorporated into a tabletop sweetener or "cup-for-cup" product. Such products typically are diluted to the appropriate sweetness level with one or more bulking agents, e.g., maltodextrins, known to those skilled in the art. Steviol glycoside compositions enriched for RebA, RebB, RebD, RebE, or RebM, can be package in a sachet, for example, at from 10,000 to 30,000 mg steviol glycoside/kg product on a dry weight basis, for tabletop use.

The invention will be further described in the following examples, which do not limit the scope of the invention described in the claims.

EXAMPLES

The Examples that follow are illustrative of specific embodiments of the invention, and various uses thereof.

They are set forth for explanatory purposes only, and are not to be taken as limiting the invention.

Example 1. LC-MS Analytical Procedures

The LC-MS methods described here are oriented towards the separation, general detection and potential identification of chemicals of particular masses (i.e. steviol glycosides) in the presence of a mixture (i.e. culture media). LC-MS analyses were performed on: (A) an UltiMate® 3000-TSQ (Thermo Fisher Scientific); (B) a 1290 Infitity—6130SQ (Agilent); or (C) an Acquity—XevoTQD (Waters) system. Specific methods used for each system are described below.

Method A:

LC-MS analyses were performed using an UltiMate® 3000 UPLC system (Dionex) fitted with a waters ACQUITY UPLC® BEH shield RP18 column (2.1×50 mm, 1.7 μm particles, 130 Å pore size) connected to a TSQ Quantum® Access (ThermoFisher Scientific) triple quadrupole mass spectrometer with a heated electrospray ion (HESI) source, unless otherwise indicated. Elution was carried out using a mobile phase of eluent B (MeCN with 0.1% Formic acid) and eluent A (water with 0.1% Formic acid) by increasing the gradient from 25% to 47% B from min. 0.0 to 4.0, increasing 47% to 100% B in min. 4.0 to 5.0, holding 100% B from min. 5.0 to 6.5 re-equilibration. The flow rate was 0.4 mL/min and the column temperature 35° C. The steviol glycosides were detected using SIM (Single Ion Monitoring) with the following m/z-traces.

TABLE 1

MS analytical information for Steviol Glycosides

| Description | Exact Mass | m/z trace | compound (typical $t_R$ in min) |
|---|---|---|---|
| Steviol + 1 Glucose | $[M + H]^+$ 481.2796 $[M + Na]^+$ 503.2615 | 481.2 ± 0.5 503.1 ± 0.5 | 19-SMG (2.29), 13-SMG (3.5) |
| Steviol + 2 Glucose | $[M + Na]^+$ 665.3149 | 665 ± 0.5 | Rubusoside (2.52) Steviol-1,2-bioside (2.92) Steviol-1,3-bioside (2.28) |
| Steviol + 3 Glucose | $[M + Na]^+$ 827.3677 | 827.4 ± 0.5 | 1,2-Stevioside (2.01) 1,3-Stevioside (2.39) RebB (2.88) |
| Steviol + 4 Glucose | $[M + Na]^+$ 989.4200 | 989.4 ± 0.5 | RebA (2.0) |
| Steviol + 5 Glucose | $[M + Na]^+$ 1151.4728 | 1151.4 ± 0.5 | RebD (1.1) |
| Steviol + 6 Glucose | $[M + Na]^+$ 1313.5257 | 1313.5 ± 0.5 | RebM (1.3) |

The levels of steviol glycosides were quantified by comparing with calibration curves obtained with authentic standards from LGC Standards. For example, standard solutions of 0.5 to 100 μM RebA were typically utilized to construct a calibration curve.

Method B:

A second analytical method was performed on the Agilent system 1290 Infinity fitted with a waters ACQUITY UPLC® BEH shield RP18 column (2.1×50 mm, 1.7 μm particles, 130 Å pore size, Waters) was connected to a 6130 single quadrupol mass detector (Agilent) with a APCI ion source. Elution was carried out using a mobile phase of eluent B (MeCN with 0.1% Formic acid) and eluent A (water with 0.1% Formic acid) by increasing the gradient from 23% to 47% B from min. 0.0 to 4.0, increasing 47% to 100% B in min. 4.0 to 5.0, holding 100% B from min. 5.0 to 6.5 re-equilibration. The flow rate was 0.6 mL/min and the column temperature 50° C. The steviol glycosides were detected using SIM (Single Ion Monitoring) with the following m/z-traces.

TABLE 2

MS analytical information for Steviol Glycosides

| SIM trace No | time window | m/z trace | Exact Mass | Description | compound (typical $t_R$ in min) |
|---|---|---|---|---|---|
| 1 | 0.0-1.51 min | 1289.5 | $[M - H]^-$ 1289.5281 | Steviol + 6 Glucose | RebM (0.91) |
|  | 1.51-1.90 min | 687.3 | $[M + HCOOH - H]^-$ 687.3217 | Steviol + 2 Glucose | Rubusoside |
|  | 1.90-5.0 min | 641.0 | $[M - H]^-$ 641.3168 | Steviol + 2 Glucose | 1,2-Stevioside (1.44) 1,3-stevioside (1.74) |
| 2 | 0.0-1.0 min | 1127.4 | $[M - H]^-$ 1127.4752 | Steviol + 5 Glucose | RebD (0.81) |
|  | 1.0-5.0 min | 525.3 | $[M - HCOOH - H]^-$ 525.2689 | Steviol + 1 Glucose | 19SMG (2.49) 13SMG (2.65) |
| 3 | 0.0-2.8 min | 965.4 | $[M - H]^-$ 965.4224 | Steviol + 4 Glucose | RebA (1.42) |
| 4 | 0.0-3.2 min | 803.4 | $[M - H]^-$ 803.3696 | Steviol + 2 Glucose | 1,2-Stevioside (2.16) 1,3-Stevioside (2.34) RebB (2.13) |

The levels of steviol glycosides were quantified by comparing with calibration curves obtained with authentic standards from LGC Standards. For example, standard solutions of 0.3 to 25 μM RebA were typically utilized to construct a calibration curve.

Method C:

A third analytical method used was LC-MS analyses performed using a Waters ACQUITY UPLC (Waters Corporation, Milford, Mass.) with Waters ACQUITY UPLC® BEH C18 column (2.1×50 mm, 1.7 μm particles, 130 Å pore size) coupled to a Waters ACQUITY TQD triple quadrupole mass spectrometer with electrospray ionization (ESI) in negative mode. Compound separation was achieved by a gradient of the two mobile phases A (water with 0.1% formic acid) and B (MeCN with 0.1% formic acid) by increasing from 20% to 50% B between 0.3 to 2.0 min, increasing to 100% B at 2.01 min, holding 100% B for 0.6 min and re-equilibrate for another 0.6 min. The flow rate was 0.6 mL/min and the column temperature 55° C. RebD (m/z 1127.5), RebM (m/z 1289.5), redaudioside A (m/z 965.4) and RebB (m/z 803.4) were monitored using SIM (Single Ion Monitoring) and quantified by comparing with authentic standards.

Example 2. Construction of a Steviol Glycoside-Producing Yeast Strain

Steviol glycoside-producing *S. cerevisiae* strains were constructed as described in WO 2011/153378, WO 2013/022989, WO 2014/122227, and WO 2014/122328, each of which is incorporated by reference in its entirety. For example, a yeast strain comprising a recombinant gene encoding a *Synechococcus* sp. GGPPS polypeptide (SEQ ID NO:1, SEQ ID NO:149), a recombinant gene encoding a truncated *Zea mays* CDPS polypeptide (SEQ ID NO:2, SEQ ID NO:150), a recombinant gene encoding an *A. thaliana* KS polypeptide (SEQ ID NO:3, SEQ ID NO:151), a recombinant gene encoding a recombinant *S. rebaudiana* KO1 polypeptide (SEQ ID NO:4, SEQ ID NO:152), a recombinant gene encoding an *A. thaliana* ATR2 polypeptide (SEQ ID NO:5, SEQ ID NO:153), a recombinant gene encoding an *O. sativa* EUGT11 polypeptide (SEQ ID NO:12; SEQ ID NO:148), a recombinant gene encoding an SrKAHe1 polypeptide (SEQ ID NO:6, SEQ ID NO:154), a recombinant gene encoding an *S. rebaudiana* CPR8 polypeptide (SEQ ID NO:7, SEQ ID NO:155), a recombinant gene encoding an *S. rebaudiana* UGT85C2 polypeptide (SEQ ID NO:8, SEQ ID NO:156), a recombinant gene encoding an *S. rebaudiana* UGT74G1 polypeptide (SEQ ID NO:9, SEQ ID NO:157), a recombinant gene encoding an *S. rebaudiana* UGT76G1 polypeptide (SEQ ID NO:10, SEQ ID NO:158), and a recombinant gene encoding an *S. rebaudiana* UGT91D2 variant (or functional homolog), UGT91D2e-b (SEQ ID NO:11, SEQ ID NO:159) polypeptide produced steviol glycosides. As analyzed by LC-MS (Method C) following DMSO-extraction of total steviol glycosides from the whole cell and broth mixture (total production), the strain produced between 18-21 µg/mL or 1-1.5 µg/mL/OD$_{600}$ RebM after growth for five days in 1 mL SC (Synthetic Complete) media at 30° C. with 400 rpm shaking in deep-well plates. See Table 3.

TABLE 3

Steviol glycoside production in a representative *S. cerevisiae* strain comprising genes encoding GGPPS, truncated CDPS, KS, KO, ATR2, EUGT11, SrKAHe1, CPR8, UGT85C2, UGT74G1, UGT76G1, and EUGT11 polypeptides.

| RebB (µg/mL/ OD$_{600}$) | RebA (µg/mL/ OD$_{600}$) | RebD (µg/mL/ OD$_{600}$) | RebM (µg/mL/ OD$_{600}$) | Normalized by OD$_{600}$ |
|---|---|---|---|---|
| 0.21 | 0.33 | 0.33 | 1.3 | Average |
| 0.028 | 0.054 | 0.032 | 0.14 | Std Deviation |

| RebB (µg/mL) | RebA (µg/mL) | RebD (µg/mL) | RebM (µg/mL) | |
|---|---|---|---|---|
| 3.1 | 4.9 | 5.0 | 19.0 | Average |
| 0.42 | 0.81 | 0.48 | 2.1 | Std Deviation |

A second strain, which comprised additional copies of the genes of the first strain, was analyzed for steviol glycoside production. The second strain produced RebD and RebM as primary steviol glycosides, although at higher levels than the first strain.

As analyzed by LC-MS (Method C) following DMSO-extraction of total steviol glycosides from the whole cell and broth mixture (total production), the second strain produced between 60-80 µg/mL or 4-6 µg/mL/OD$_{600}$ RebM, after growth for five days in 1 mL SC media at 30° C. with 400 rpm shaking in deep-well plates. Production of RebA, RebB, RebD and RebM by the second strain is shown in Table 4.

TABLE 4

Steviol glycoside production in an *S. cerevisiae* strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides.

| RebA (µg/mL/ OD$_{600}$) | RebB (µg/mL/ OD$_{600}$) | RebD (µg/mL/ OD$_{600}$) | RebM (µg/mL/ OD$_{600}$) | Normalized by OD$_{600}$ |
|---|---|---|---|---|
| 2.1 | 0.67 | 1.6 | 4.8 | Average |
| 0.66 | 0.21 | 0.75 | 2.3 | Std Deviation |

| RebA (µg/mL) | RebB (µg/mL) | RebD (µg/mL) | RebM (µg/mL) | |
|---|---|---|---|---|
| 31.0 | 10.1 | 23.7 | 72.5 | Average |
| 9.9 | 3.1 | 11.3 | 34.4 | Std Deviation |

Example 3. Knockout of Yeast Endogenous Transport Genes and Transport-Related Genes Observations from deep-well studies of Example 2 and similar strains indicated that the fraction of RebA, RebB, RebD or RebM in the supernatant changes with time, and the effect was determined not to be the result of cell lysis. To determine the effect of various transporters on steviol glycoside excretion in *S. cerevisiae*, deletion cassettes for homologous recombination were obtained by designing primers annealing approximately 200 bp upstream and downstream of the open reading frame (ORF) and then amplifying the ORF-specific deletion cassette from the *S. cerevisiae* deletion collection. The candidate genes selected include identified ORFs with relation to transport or comprising membrane spanning domains, regardless of subcellular localization. In the resulting colonies, the presence of the deletion cassette at the correct locus was verified by colony PCR. A maximum of 6 clones of each deletion was frozen down as freezer stock. All samples for analysis were initiated from the freezer stock and grown in SC medium for 5 days (30° C., shaking 400 rpm) prior to harvest and extraction of samples for LC-MS. Samples were analyzed for the presence of RebA, RebB, RebD and RebM in the culture broth lacking cells (Supernatant) as well as in the whole cell and broth mixture (Total production).

Concentrations of total and supernatant RebA, RebB, RebD and RebM were compared to the levels in a control steviol glycoside-producing strain. The amounts of RebA, RebB, RebD and RebM in each sample were normalized to the control strain by dividing the value of a particular steviol glycoside with the corresponding value for the control strain, thereby calculating a percentage to the control strain, where 1 equals 100 percent. The "ideal candidate" would exhibit a decrease in RebA, RebB, RebD and/or RebM levels in the supernatant, as compared to the control steviol glycoside-producing strain, without decreasing RebA, RebB, RebD, and/or RebM total production.

The effect of yeast gene knockouts on transport of higher molecular weight steviol glycosides into the culture medium was tested in a strain that produces steviol glycosides, such as the strains described in Example 2. Disruption of each specific transporter gene was performed by homologous recombination. After 5 days of growth in 1 mL SC medium at 30° C. and 400 rpm, cells were harvested. A 50 µL aliquot of the culture was mixed with an equal volume of 100% DMSO, vortexed, and heated to 80° C. for 10 min. The suspension was then centrifuged to remove cell debris. 60 µL of the mixture were analyzed by LC-MS as the "Total" sample. The remaining culture was then centrifuged to pellet cells. An aliquot of 50 µL was removed from the supernatant (i.e., the culture medium) and mixed with an equal volume of 100% DMSO. The suspension was heated to 80° C. for 10 min and centrifuged. 60 µL of the mixture were analysed by LC-MS as the "Supernatant" sample. The amounts of higher molecular weight steviol glycosides (including RebA, RebB, RebD, RebM) were measured by LC-MS (Method C), as described in Example 1.

The data demonstrate that disruption of a single endogenous yeast transporter gene in a steviol glycoside-producing strain resulted in a decrease in the level of various steviol glycosides in the supernatant of the culture media, as evaluated by the normalized amount transported into the supernatant (see Tables 5-10). Tables 5-10 comprise lists of transport related genes that were knocked out in a steviol glycoside-producing strain. More specifically, Table 5 comprises a compiled list of genes by ordered locus name found to affect steviol glycoside excretion in steviol glycoside-producing strains and are therefore identified as having a role in steviol glycoside excretion. When the specified genes were knocked out, a more than 40% decrease in either the supernatant alone or in the ratio of supernatant/total production of RebA, RebB, RebD, and/or RebM was observed. This corresponded approximately to more than 2 standard deviations removed from the mean of a control steviol glycoside-producing strain (a value of 1 equals 100 percent of the control strain, whereas a value of 0.5 indicates a 50% decrease).

Table 6 comprises a compiled list of genes by ordered locus name found to affect steviol glycoside excretion in steviol glycoside-producing strains and are therefore identified as having a role in steviol glycoside excretion. When knocked out, these genes caused a mean of between 20-40% decrease in either the supernatant alone or in the ratio of supernatant/total production. This corresponded to approximately between 1 and 2 standard deviations removed from the mean of the control strain (a value of 1 equals 100 percent of the control strain, whereas a value of 0.5 indicates a 50% decrease).

TABLE 5

Transport related genes with over a 40% decrease in Reb A, RebB, RebD or RebM levels compared to a control steviol glycoside-producing strain.

| SEQ ID No. | Ordered Locus Name | Family | Description | Gene name | Uniprot Accession No. |
|---|---|---|---|---|---|
| 13 | YBR180W | MFS | Secondary Transporter | DTR1 | P38125 |
| 14 | YAL067C | MFS | Secondary Transporter | SEO1 | P39709 |
| 15 | YBL089W | AAAP | Secondary Transporter | AVT5 | P38176 |
| 16 | YBL099W | F-ATPase | ATP-Dependent | ATP1 | P07251 |
| 17 | YBR241C | MFS | Secondary Transporter | | P38142 |
| 18 | YBR294W | SulP | Secondary Transporter | SUL1 | P38359 |
| 19 | YCL069W | MFS | Secondary Transporter | VBA3 | P25594 |
| 20 | YCR028C | MFS | Secondary Transporter | FEN2 | P25621 |
| 21 | YCR075C | LCT | Secondary Transporter | ERS1 | P17261 |
| 22 | YDL128W | CaCA | Secondary Transporter | VCX1 | Q99385 |
| 23 | YDL185W | F-ATPase | ATP-Dependent | VMA1 | P17255 |
| 24 | YDL194W | MFS | Secondary Transporter | SNF3 | P10870 |
| 25 | YDL210W | APC | Secondary Transporter | UGA4 | P32837 |
| 26 | YDR061W | ABC | ATP-Dependent | | Q12298 |
| 27 | YDR093W | P-ATPase | ATP-Dependent | DNF2 | Q12675 |
| 28 | YDR338C | MOP/MATE | Secondary Transporter | | Q05497 |
| 29 | YDR406W | ABC | ATP-Dependent | PDR15 | Q04182 |
| 30 | YDR536W | MFS | Secondary Transporter | STL1 | P39932 |
| 31 | YEL031W | P-ATPas | ATP-Dependent | SPF1 | P39986 |
| 32 | YER166W | P-ATPase | ATP-Dependent | DNF1 | P32660 |
| 33 | YFL011W | MFS | Secondary Transporter | HXT10 | P43581 |
| 34 | YGL006W | P-ATPase | ATP-Dependent | PMC1 | P38929 |
| 35 | YGL013C | | Transcription factor | PDR1 | P12383 |
| 36 | YGL255W | ZIP | Secondary Transporter | ZRT1 | P32804 |
| 37 | YGR125W | SulP | Secondary Transporter | | P53273 |
| 38 | YGR181W | MPT | ATP-Dependent | TIM13 | P53299 |
| 39 | YGR217W | VIC | Ion Channels | CCH1 | P50077 |
| 40 | YGR224W | MFS | Secondary Transporter | AZR1 | P50080 |
| 41 | YGR281W | ABC | ATP-Dependent | YOR1 | P53049 |
| 42 | YHL016C | SSS | Secondary Transporter | DUR3 | P33413 |
| 43 | YIL088C | AAAP | Secondary Transporter | AVT7 | P40501 |
| 44 | YJL093C | VIC | Ion Channels | TOK1 | P40310 |
| 45 | YJL094C | CPA2 | Secondary Transporter | KHA1 | P40309 |
| 46 | YJL108C | ThrE | Secondary Transporter | PRM10 | P42946 |
| 47 | YJL212C | OPT | Secondary Transporter | OPT1 | P40897 |
| 48 | YJR106W | CaCA | Secondary Transporter | ECM27 | P47144 |

| No. | Ordered Locus Name | Family | Description | Gene name | Uniprot Accession No. |
|---|---|---|---|---|---|
| 49 | YJR160C | MFS | Secondary Transporter | MPH3 | P0CE00 |
| 50 | YKL064W | MIT | Ion Channels | MNR2 | P35724 |

TABLE 5-continued

Transport related genes with over a 40% decrease in Reb A, RebB, RebD or RebM levels compared to a control steviol glycoside-producing strain.

| | | | | | |
|---|---|---|---|---|---|
| 51 | YKR050W | Trk | Secondary Transporter | TRK2 | P28584 |
| 52 | YKR105C | MFS | Secondary Transporter | VBA5 | P36172 |
| 53 | YKR106W | MFS | Secondary Transporter | GEX2 | P36173 |
| 54 | YLR447C | F-ATPase | ATP-Dependent | VMA6 | P32366 |
| 55 | YML116W | MFS | Secondary Transporter | SNQ1/ATR1 | P13090 |
| 56 | YMR034C | BASS | Secondary Transporter | | Q05131 |
| 57 | YMR056C | MC | Secondary Transporter | AAC1 | P04710 |
| 58 | YMR253C | DMT | Secondary Transporter | | Q04835 |
| 59 | YNL065W | MFS | Secondary Transporter | AQR1 | P53943 |
| 60 | YNL070W | MPT | ATP-Dependent | TOM7 | P53507 |
| 61 | YNL083W | MC | Secondary Transporter | SAL1 | D6W196 |
| 62 | YNL095C | AEC | Secondary Transporter | | P53932 |
| 63 | YNL121C | MPT | ATP-Dependent | TOM70 | P07213 |
| 64 | YNL142W | Amt | Ion Channels | MEP2 | P41948 |
| 65 | YOL020W | APC | Secondary Transporter | TAT2 | P38967 |
| 66 | YOL075C | ABC | ATP-Dependent | | Q08234 |
| 67 | YOL077W-A | F-ATPase | ATP-Dependent | ATP19 | P81451 |
| 68 | YOL122C | Nramp | Secondary Transporter | SMF1 | P38925 |
| 69 | YOR079C | ZIP | Secondary Transporter | ATX2 | Q12067 |
| 70 | YOR087W | TRP-CC | Ion Channels | YVC1 | Q12324 |
| 71 | YOR092W | AEC | Secondary Transporter | ECM3 | Q99252 |
| 72 | YOR130C | MC | Secondary Transporter | ORT1 | Q12375 |
| 73 | YOR222W | MC | Secondary Transporter | ODC2 | Q99297 |
| 74 | YOR291W | P-ATPase | ATP-Dependent | YPK9 | Q12697 |
| 75 | YOR306C | MFS | Secondary Transporter | MCH5 | Q08777 |
| 76 | YOR316C | CDF | Secondary Transporter | COT1 | P32798 |
| 77 | YOR334W | MIT | Ion Channels | MRS2 | Q01926 |
| 78 | YPL078C | F-ATPase | ATP-Dependent | ATP4 | P05626 |
| 79 | YPL270W | ABC | ATP-Dependent | MDL2 | P33311 |
| 80 | YPL274W | APC | Secondary Transporter | SAM3 | Q08986 |
| 81 | YPR003C | SulP | Secondary Transporter | | P53394 |
| 82 | YPR011C | MC | Secondary Transporter | | Q12251 |
| 83 | YPR058W | MC | Secondary Transporter | YMC1 | P32331 |
| 84 | YPR128C | MC | Secondary Transporter | ANT1 | Q06497 |
| 85 | YPR201W | ACR3 | Secondary Transporter | ARR3 | Q06598 |

TABLE 6

Transport related genes with a 20-40% decrease in Reb A, RebB, RebD or RebM levels compared to a control steviol glycoside-producing strain.

| SEQ ID No. | Ordered Locus Name | Family | Description | Gene name | Uniprot Accession No. |
|---|---|---|---|---|---|
| 86 | YBR008C | MFS | Secondary Transporter | FLR1 | P38124 |
| 87 | YBR021W | NCS1 | Secondary Transporter | FUR4 | P05316 |
| 88 | YBR043C | MFS | Secondary Transporter | QDR3 | P38227 |
| 89 | YBR287W | AEC | Secondary Transporter | | P38355 |
| 90 | YBR295W | P-ATPase | ATP-Dependent | PCA1 | P38360 |
| 91 | YBR296C | PiT | Secondary Transporter | PHO89 | P38361 |
| 92 | YCL038C | MFS | Secondary Transporter | ATG22 | P25568 |
| 93 | YCR011C | ABC | ATP-Dependent | ADP1 | P25371 |
| 94 | YDL054C | MFS | Secondary Transporter | MCH1 | Q07376 |
| 95 | YDL100C | ArsAB | ATP-Dependent | GET3 | Q12154 |
| 96 | YDL245C | MFS | Secondary Transporter | HXT15 | P54854 |
| 97 | YDL247W | MFS | Secondary Transporter | MPH2 | P0CD99 |
| 98 | YDR011W | ABC | ATP-Dependent | SNQ2 | P32568 |
| 99 | YDR292C | IISP | ATP-Dependent | SRP101 | P32916 |
| 100 | YDR497C | MFS | Secondary Transporter | ITR1 | P30605 |
| 101 | YEL006W | MC | Secondary Transporter | YEA6 | P39953 |
| 102 | YEL027W | F-ATPase | ATP-Dependent | VMA3 | P25515 |
| 103 | YEL065W | MFS | Secondary Transporter | SIT1 | P39980 |
| 104 | YER019C-A | IISP | ATP-Dependent | SBH2 | P52871 |
| 105 | YER053C | MC | Secondary Transporter | PIC2 | P40035 |
| 106 | YER119C | AAAP | Secondary Transporter | AVT6 | P40074 |
| 107 | YFL028C | ABC | ATP-Dependent | CAF16 | P43569 |
| 108 | YFR045W | MC | Secondary Transporter | | P43617 |
| 109 | YGL084C | GUP | Secondary Transporter | GUP1 | P53154 |
| 110 | YGL104C | MFS | Secondary Transporter | VPS73 | P53142 |
| 111 | YGL114W | OPT | Secondary Transporter | | P53134 |
| 112 | YGL167C | P-ATPase | ATP-Dependent | PMR1 | P13586 |
| 113 | YGR257C | MC | Secondary Transporter | MTM1 | P53320 |

TABLE 6-continued

Transport related genes with a 20-40% decrease in Reb A, RebB, RebD or RebM levels compared to a control steviol glycoside-producing strain.

| No. | Ordered Locus Name | Family | Description | Gene name | Accession No. |
|---|---|---|---|---|---|
| 114 | YHL035C | ABC | ATP-Dependent | VMR1 | P38735 |
| 115 | YHL036W | APC | Secondary Transporter | MUP3 | P38734 |
| 116 | YHR002W | MC | Secondary Transporter | LEU5 | P38702 |
| 117 | YHR096C | MFS | Secondary Transporter | HXT5 | P38695 |
| 118 | YIL006W | MC | Secondary Transporter | YIA6 | P40556 |
| 119 | YIL120W | MFS | Secondary Transporter | QDR1 | P40475 |
| 120 | YIL121W | MFS | Secondary Transporter | QDR2 | P40474 |
| 121 | YIL166C | MFS | Secondary Transporter | SOA1 | P40445 |
| 122 | YJL133W | MC | Secondary Transporter | MRS3 | P10566 |
| 123 | YJL219W | MFS | Secondary Transporter | HXT9 | P40885 |
| 124 | YKL016C | F-ATPase | ATP-Dependent | ATP7 | P30902 |
| 125 | YKL050C | MIT | Ion Channels | | P35736 |
| 126 | YKL120W | MC | Secondary Transporter | OAC1 | P32332 |
| 127 | YKL146W | AAAP | Secondary Transporter | AVT3 | P36062 |
| 128 | YKL209C | ABC | ATP-Dependent | STE6 | P12866 |
| 129 | YKR039W | APC | Secondary Transporter | GAP1 | P19145 |
| 130 | YLR411W | Ctr | Ion Channels | CTR3 | Q06686 |
| 131 | YML038C | DMT | Secondary Transporter | YMD8 | Q03697 |
| 132 | YMR166C | MC | Secondary Transporter | | Q03829 |
| 133 | YMR279C | MFS | Secondary Transporter | | Q03263 |
| 134 | YNL003C | MC | Secondary Transporter | PET8 | P38921 |
| 135 | YNL268W | APC | Secondary Transporter | LYP1 | P32487 |
| 136 | YNR055C | MFS | Secondary Transporter | HOL1 | P53389 |
| 137 | YOL158C | MFS | Secondary Transporter | ENB1 | Q08299 |
| 138 | YOR100C | MC | Secondary Transporter | CRC1 | Q12289 |
| 139 | YOR153W | ABC | ATP-Dependent | PDR5 | P33302 |
| 140 | YOR271C | MTC | Secondary Transporter | FSF1 | Q12029 |
| 141 | YOR273C | MFS | Secondary Transporter | TPO4 | Q12256 |
| 142 | YOR307C | DMT | Secondary Transporter | SLY41 | P22215 |
| 143 | YOR332W | F-ATPase | ATP-Dependent | VMA4 | P22203 |
| 144 | YOR348C | APC | Secondary Transporter | PUT4 | P15380 |
| 145 | YPL036W | P-ATPase | ATP-Dependent | PMA2 | P19657 |

Steviol glycoside exporter candidates were selected from the data based on two selection criteria for each steviol glycoside measured (i.e., two methods of normalizing expression).

Transporter selection criterion 1 corresponded to selection based on the level of high molecular weight steviol glycosides (RebA, RebB, RebD, or RebM) available in the supernatant, as well as the total production of the said steviol glycoside. Both values were normalized to the value of the corresponding steviol glycoside-producing control strain. The control level was set to 1, and the corresponding steviol glycoside level was calculated as a percentage of the control. For Ordered Locus Names (i.e., genes) of interest, the steviol glycoside available in the supernatant should be below 0.6 (below 60% of the control) or between 0.8-0.6 (80-60% of the control). To avoid false positives or a bias towards transporters that decrease the production in general, the calculation had an additional requirement that the total production had to be similar to the control. In the current calculation, production was set to be between 0.85 and 1.15 of the control, when the control is set to 1. In this regard, steviol glycoside production levels did not affect results. Table 7 shows the supernatant/total ratio for each candidate that fulfills the selection criteria.

Transporter selection criterion 2 corresponded to selection based on the ratio of high molecular weight steviol glycosides (RebA, RebB, RebD, or RebM) in the supernatant relative to total production of the said steviol glycoside. The supernatant-to-total production ratio was normalized to the ratio of the corresponding steviol glycoside-producing strain control. The control level was set to 1, and the corresponding steviol glycoside ratio was calculated as a percentage of the control. For Ordered Locus Names (i.e., genes) of interest, the supernatant-to-total production ratio for a given steviol glycoside should be below 0.6 (below 60% of the control) or between 0.8-0.6 (80-60% of the control). To avoid false positives or a bias towards transporters that decrease the production in general, the calculation had an additional requirement that the total production had to be similar to the control. In the current calculation, production was set to be between 0.85 and 1.15 of the control, when the control is set to 1. In this regard, steviol glycoside production levels did not affect results. Table 8 shows the supernatant/total ratio for each candidate that fulfills the selection criteria.

The data demonstrate that disruption of a single endogenous yeast transporter gene in a steviol glycoside-producing strain resulted in a decrease in the level of various steviol glycosides in the supernatant of the culture media, as evaluated by the normalized amount transported into the supernatant (see Tables 5-10), and are therefore identified as having a role in steviol glycoside excretion.

For example, deletion in a steviol glycoside-producing strain of YDL128W (SEQ ID NO:22), YDL194W (SEQ ID NO:24), YDL210W (SEQ ID NO:25), YFL011W (SEQ ID NO:33), YGL006W (SEQ ID NO:34), YGL013C (SEQ ID NO:35), YGL255W (SEQ ID NO:36), YGR181W (SEQ ID NO:38), YGR217W (SEQ ID NO:39), YIL088C (SEQ ID NO:43), YJL094C (SEQ ID NO:45), YJR106W (SEQ ID NO:48), YNL065W (SEQ ID NO:59), YNL083W (SEQ ID NO:61), YNL121C (SEQ ID NO:63), YNL142W (SEQ ID NO:64), YOR306C (SEQ ID NO:75), or YPR011C (SEQ ID NO:82) led to a measurable decrease of RebD excreted into the culture medium, indicating that each plays a role in RebD excretion. This was confirmed by transporter selection criteria 1 and 2 (see Tables 7 and 8, RebD column).

Furthermore, for example, deletion in a steviol glycoside-producing strain of YBR180W (SEQ ID NO:13), YBR241C (SEQ ID NO:17), YCL069W (SEQ ID NO:19), YCR075C (SEQ ID NO:21), YDL128W (SEQ ID NO:22), YDL194W (SEQ ID NO:24), YDR093W (SEQ ID NO:27), YDR338C (SEQ ID NO:28), YER166W (SEQ ID NO:32), YFL011W (SEQ ID NO:33), YGL006W (SEQ ID NO:34), YGL013C (SEQ ID NO:35), YGL255W (SEQ ID NO:36), YGR217W (SEQ ID NO:39), YJL094C (SEQ ID NO:45), YJR106W (SEQ ID NO:48), YJR160C (SEQ ID NO:49), YKR106W (SEQ ID NO:53), YML116W (SEQ ID NO:55), YMR056C (SEQ ID NO:57), YNL070W (SEQ ID NO:60), YNL083W (SEQ ID NO:61), YNL095C (SEQ ID NO:62), YNL121C (SEQ ID NO:63), YOR087W (SEQ ID NO:70), YOR291W (SEQ ID NO:74), YOR306C (SEQ ID NO:75), YPL274W (SEQ ID NO:80), or YPR011C (SEQ ID NO:82) led to a measurable decrease of RebM, indicating that each plays a role in RebM excretion. This was confirmed by transporter selection criteria 1 and 2 (see Tables 7 and 8, RebM column).

Table 7 represents the calculated ratio, normalized to a steviol glycoside-producing strain comprising genes encoding GGPPS, truncated CDPS, KS, KO, ATR2, EUGT11, SrKAHe1, CPR8, UGT85C2, UGT74G1, UGT76G1, and EUGT11 polypeptides, of supernatant/total production for each gene (by ordered locus name) deleted in the steviol glycoside-producing strain. The supernatant or supernatant/total ratio of less than 0.6 represented a more than 40% decrease in either the supernatant alone or in the ratio of supernatant/total production of RebA, RebB, RebD, or RebM, which corresponded approximately to more than 2 standard deviations removed from the mean of the control steviol glycoside-producing strain and indicates the gene as having a role in steviol glycoside transportation (Table 7). The supernatant or ratio supernatant/total of between 0.6 and 0.8 represents a 40-20% decrease in either the supernatant alone or in the ratio of supernatant/total production of RebA, RebB, RebD, or RebM, which corresponds to approximately between 1 and 2 standard deviations removed from the mean of the control steviol glycoside-producing strain, and indicates the gene as having a role in steviol glycoside transportation and/or production (Table 8). Total production of each steviol glycoside was between 0.85 and 1.15 compared to the steviol glycoside-producing strain. Table 8 shows the supernatant/total ratio for each candidate that fulfills the selection criteria.

TABLE 7

Transport related genes with over a 40% decrease in RebA, RebB, RebD or RebM compared to a control steviol glycoside-producing strain comprising genes encoding GGPPS, truncated CDPS, KS, KO, ATR2, EUGT11, SrKAHe1, CPR8, UGT85C2, UGT74G1, UGT76G1, and EUGT11 polypeptides.

| | Transporter selection criterion 1 Total vs. Supernatant | | | | Transporter selection criterion 2 Ratio Sup/Total vs. Total | | | |
|---|---|---|---|---|---|---|---|---|
| | RebA | RebB | RebD | RebM | RebA | RebB | RebD | RebM |
| YBR180W | | | | 0.486 | | | | 0.486 |
| YBR241C | | | | 0.529 | | | | 0.529 |
| YCL069W | | | | 0.519 | | | | 0.519 |
| YCR075C | | | | 0.448 | | | | 0.448 |
| YDL128W | | | 0.459 | 0.405 | | | 0.459 | 0.405 |
| YDL194W | | | 0.652 | 0.482 | | | | 0.482 |
| YDL210W | | | 0.000 | | | | 0.000 | |
| YDR093W | | | | 0.569 | | | | 0.569 |
| YDR338C | | | | 0.451 | | | | 0.451 |
| YEL031W | | 0.488 | | | | 0.488 | | |
| YER166W | | | | 0.495 | | | | 0.495 |
| YFL011W | | | 0.581 | 0.547 | | | 0.581 | 0.547 |
| YGL006W | | | | | | | 0.410 | 0.424 |
| YGL013C | | | 0.673 | 0.507 | | | | 0.507 |
| YGL255W | | | 0.669 | 0.632 | | | | |
| YGR181W | | | 0.419 | | | | 0.419 | |
| YGR217W | | | 0.598 | 0.429 | | | 0.598 | 0.429 |
| YIL088C | | | 0.135 | | | | 0.135 | |
| YJL094C | | | 0.568 | 0.525 | | | 0.568 | 0.525 |
| YJR106W | | | 0.470 | 0.432 | | | 0.470 | 0.432 |
| YJR160C | | | | 0.689 | | | | |
| YKL064W | | 0.337 | | | | 0.337 | | |
| YKR106W | | | | 0.509 | | | | 0.509 |
| YML116W | | | | 0.706 | | | | |
| YMR056C | | | | | | | | 0.591 |
| YNL065W | | | | | | | 0.571 | |
| YNL070W | | | | 0.633 | | | | |
| YNL083W | | | | 0.481 | | | 0.592 | 0.481 |
| YNL095C | | | | 0.610 | | | | |
| YNL121C | | | 0.620 | 0.456 | | | | 0.456 |
| YNL142W | 0.561 | | 0.369 | | 0.561 | | 0.369 | |
| YOR087W | | | | 0.611 | | | | |
| YOR291W | | | | 0.681 | | | | |
| YOR306C | | | 0.596 | 0.559 | | | 0.596 | 0.559 |
| YOR334W | | 0.520 | | | | 0.520 | | |
| YPL078C | | 0.590 | | | | 0.590 | | |
| YPL270W | | 0.665 | | | | | | |

TABLE 7-continued

Transport related genes with over a 40% decrease in RebA, RebB, RebD or RebM compared to a control steviol glycoside-producing strain comprising genes encoding GGPPS, truncated CDPS, KS, KO, ATR2, EUGT11, SrKAHe1, CPR8, UGT85C2, UGT74G1, UGT76G1, and EUGT11 polypeptides.

| | Transporter selection criterion 1 Total vs. Supernatant | | | | Transporter selection criterion 2 Ratio Sup/Total vs. Total | | | |
|---|---|---|---|---|---|---|---|---|
| | RebA | RebB | RebD | RebM | RebA | RebB | RebD | RebM |
| YPL274W | | | | 0.561 | | | | 0.561 |
| YPR011C | | | 0.542 | 0.611 | | | 0.542 | |

TABLE 8

Transport related genes with a 20-40% decrease in Reb A, RebB, RebD or RebM compared to a control steviol glycoside-producing strain comprising genes encoding GGPPS, truncated CDPS, KS, KO, ATR2, EUGT11, SrKAHe1, CPR8, UGT85C2, UGT74G1, UGT76G1, and EUGT11 polypeptides.

| | Transports cal 1; total vs sup | | | | Transports cal 2; ratio sup/total vs total | | | |
|---|---|---|---|---|---|---|---|---|
| | RebA | RebB | RebD | RebM | RebA | RebB | RebD | RebM |
| YBL089W | | | | 0.739 | | | | 0.739 |
| YBR008C | 0.784 | | | 0.640 | 0.784 | | | 0.640 |
| YBR021W | | 0.731 | | | | 0.731 | | |
| YBR043C | 0.755 | | | 0.796 | 0.755 | | | 0.796 |
| YBR180W | | | 0.747 | | | | 0.747 | |
| YBR241C | | 0.688 | | | | 0.798 | 0.688 | |
| YBR287W | 0.781 | 0.823 | 0.768 | | 0.781 | | 0.768 | |
| YBR295W | | | 0.885 | 0.876 | | | | |
| YBR296C | | 0.724 | 0.799 | 0.790 | | 0.724 | 0.799 | 0.790 |
| YCL038C | | 0.709 | | 0.752 | | 0.709 | | 0.752 |
| YCL069W | | | 0.785 | | | | 0.785 | |
| YCR075C | | | 0.634 | | | | 0.634 | |
| YDL054C | | | 0.920 | | | | | |
| YDL100C | | | 0.867 | | | | | |
| YDL194W | | | | | | | 0.652 | |
| YDL210W | | | | 0.834 | | | | |
| YDL245C | 0.852 | | | | | | | |
| YDL247W | | | | 0.682 | | | | 0.682 |
| YDR011W | | | 0.852 | | | | | |
| YDR093W | 0.792 | 0.775 | 0.704 | | 0.792 | 0.775 | 0.704 | |
| YDR338C | 0.711 | 0.695 | 0.680 | | 0.711 | 0.695 | 0.680 | |
| YDR497C | | | | 0.694 | | | | 0.694 |
| YEL006W | | | | 0.657 | | | 0.774 | 0.657 |
| YEL065W | | | 0.635 | | | | 0.635 | |
| YER119C | | | | 0.872 | | | | |
| YER166W | 0.771 | 0.843 | 0.687 | | 0.771 | | 0.687 | |
| YFL011W | | 0.787 | | | | 0.787 | | |
| YFL028C | | | 0.641 | | | | 0.641 | |
| YFR045W | | | 0.779 | | | | 0.779 | |
| YGL006W | | | 0.410 | 0.424 | | | | |
| YGL013C | | | | | | | 0.673 | |
| YGL084C | | 0.804 | | | | | | |
| YGL104C | 0.628 | 0.731 | | 0.683 | 0.628 | 0.731 | | 0.683 |
| YGL114W | | | | | | 0.796 | | |
| YGL167C | 0.829 | | | | | | | |
| YGL255W | | | | | | | 0.669 | 0.632 |
| YGR217W | | 0.801 | | | | | | |
| YGR257C | 0.842 | | | | | | | |
| YHL035C | | | 0.900 | 0.792 | | | | 0.792 |
| YHL036W | | | | 0.798 | | | | 0.798 |
| YHR096C | | | 0.879 | 0.798 | | | | 0.798 |
| YIL006W | 0.763 | | | 0.689 | 0.763 | | 0.791 | 0.689 |
| YIL120W | | | | 0.814 | | | | |
| YIL121W | | | 0.903 | | | | | |
| YIL166C | | | 0.844 | | | | | |
| YJL212C | | | 0.817 | 0.682 | | | | 0.682 |
| YJR106W | 0.719 | | | | 0.719 | | | |
| YJR160C | | 0.781 | 0.985 | | | 0.781 | | 0.689 |
| YKL050C | | | | 0.896 | | | | |
| YKL120W | | | | 0.706 | | | | 0.706 |
| YKL146W | | 0.890 | | | | | | |
| YKR039W | 0.763 | | | | 0.763 | | | |

TABLE 8-continued

Transport related genes with a 20-40% decrease in Reb A, RebB, RebD or RebM compared to a control steviol glycoside-producing strain comprising genes encoding GGPPS, truncated CDPS, KS, KO, ATR2, EUGT11, SrKAHe1, CPR8, UGT85C2, UGT74G1, UGT76G1, and EUGT11 polypeptides.

| | Transports cal 1; total vs sup | | | | Transports cal 2; ratio sup/total vs total | | | |
|---|---|---|---|---|---|---|---|---|
| | RebA | RebB | RebD | RebM | RebA | RebB | RebD | RebM |
| YKR106W | | 0.785 | 0.738 | | | 0.785 | 0.738 | |
| YLR411W | 0.852 | | 0.782 | | | | 0.782 | |
| YML038C | | | 0.724 | | | | 0.724 | |
| YML116W | | | | 0.898 | | | | 0.706 |
| YMR056C | | | 0.675 | 0.591 | | 0.786 | 0.675 | |
| YMR279C | | | | 0.885 | | | | |
| YNL065W | 0.710 | 0.792 | 0.571 | | 0.710 | 0.792 | | |
| YNL070W | 0.893 | | 0.892 | | | | | 0.633 |
| YNL083W | | | 0.592 | | | | | |
| YNL095C | | | 0.726 | | | | 0.726 | 0.610 |
| YNL121C | | | | | | | 0.620 | |
| YNL268W | | 0.920 | | | | | | |
| YNR055C | | | 0.643 | | | | 0.643 | |
| YOL122C | | | | 0.935 | | | | |
| YOL158C | | | 0.848 | 0.728 | | | | 0.728 |
| YOR087W | | | | | | | | 0.611 |
| YOR100C | | 0.916 | | | | | | |
| YOR271C | | 0.889 | 0.758 | 0.608 | | | 0.758 | 0.608 |
| YOR273C | 0.726 | 0.916 | 0.635 | | 0.726 | | 0.635 | |
| YOR291W | | | | | | | | 0.681 |
| YOR307C | | | | | | | | 0.765 |
| YOR348C | | | | 0.644 | | | | 0.644 |
| YPL036W | 0.763 | | 0.698 | | 0.763 | | 0.698 | |
| YPL078C | | | 0.798 | | | | 0.798 | |
| YPL270W | | | 0.746 | | | 0.665 | 0.746 | |
| YPL274W | 0.817 | 0.807 | 0.721 | | | | 0.721 | |
| YPR011C | 0.763 | | | | 0.763 | | | 0.611 |

The effect of yeast gene knockouts on transport of higher molecular weight steviol glycosides into the culture medium (i.e., supernatant) also was tested in a steviol glycoside-producing strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides, which was described in Example 2. The data demonstrated that disruption of a single endogenous yeast transporter gene in the steviol glycoside-producing strain resulted in a decrease in the level of various steviol glycosides in the supernatant of the culture media, as evaluated by the normalized amount transported or by the supernatant-to-total-production ratio (see Tables 9 and 10, RebD column). For example, deletion in the steviol glycoside-producing strain of YDR536W (SEQ ID NO:30), YHL016C (SEQ ID NO:42), YKR050W (SEQ ID NO:51), YOR291W (SEQ ID NO:74), YOR334W (SEQ ID NO:77), YPL270W (SEQ ID NO:79), YPR058W (SEQ ID NO:83), or YPR128C (SEQ ID NO:84) led to a measurable decrease of RebD transported into the supernatant, indicating that they play a role in RebD excretion. This was confirmed by transporter selection criteria 1 and 2 (see Tables 9 and 10, RebD column).

Furthermore, for example, deletion of YAL067C (SEQ ID NO:14), YDR406W (SEQ ID NO:29), YHL016C (SEQ ID NO:42), YJL212C (SEQ ID NO:47), YKR050W (SEQ ID NO:51), YMR034C (SEQ ID NO:56), YMR253C (SEQ ID NO:58), YOL075C (SEQ ID NO:66), YOL122C (SEQ ID NO:68), YOR222W (SEQ ID NO:73), YPR003C (SEQ ID NO:81), or YPR201W (SEQ ID NO:85) led to a measurable decrease of RebM transported into the supernatant, indicating that they play a role in RebM excretion. This was confirmed by transporter selection criteria 1 and 2 (see Tables 9 and 10, RebM column).

Table 9 represents the calculated ratio, normalized to a steviol glycoside-producing strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides, of supernatant/total production for each gene (by ordered locus name) deleted in the steviol glycoside-producing strain. The supernatant or ratio supernatant/total of less than 0.6 represents a more than 40% decrease in either the supernatant alone or in the ratio of supernatant/total production of RebA, RebB, RebD, or RebM, which corresponds approximately to more than 2 standard deviations removed from the mean of a control steviol glycoside-producing strain, and indicates the gene as having a role in steviol glycoside transportation and/or production (Table 9). The supernatant or ratio supernatant/total of between 0.6 and 0.8 represents a 40-20% decrease in either the supernatant alone or in the ratio of supernatant/total production of RebA, RebB, RebD, or RebM, which corresponds to approximately between 1 and 2 standard deviations removed from the mean of the control strain, and indicates the gene as having a role in steviol glycoside transportation and/or production, and indicates the gene as having a role in steviol glycoside transportation and/or production (Table 10). Total production of each steviol glycoside was between 0.85 and 1.15 compared to the control steviol glycoside-producing strain. Table 10 shows the supernatant/total ratio for each candidate that fulfills the selection criteria.

TABLE 9

Transport related genes with over a 40% decrease in Reb A, RebB, RebD or RebM compared to a control steviol glycoside-producing strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides.

| | Transporter selection criterion 1 total vs sup | | | | Transporter selection criterion 2 ratio sup/total vs total | | | |
|---|---|---|---|---|---|---|---|---|
| | RebA | RebB | RebD | RebM | RebA | RebB | RebD | RebM |
| YAL067C | | | | 0.541 | | | | 0.541 |
| YBL089W | 0.433 | 0.416 | | | 0.433 | 0.416 | | |
| YBL099W | 0.523 | | | | 0.523 | | | |
| YBR294W | 0.495 | | | | 0.495 | | | |
| YCR028C | | 0.419 | | | | 0.419 | | |
| YDL185W | 0.551 | | | | 0.551 | | | |
| YDL210W | 0.626 | 0.469 | | | | 0.469 | | |
| YDR061W | 0.482 | | 0.471 | | 0.482 | | 0.471 | |
| YDR406W | | | | 0.288 | | | | 0.288 |
| YDR536W | 0.715 | | 0.365 | | | | 0.365 | |
| YFL011W | | 0.444 | | | | 0.444 | | |
| YGR125W | | 0.400 | | | | 0.400 | | |
| YGR224W | | 0.361 | | | | 0.361 | | |
| YGR281W | | 0.596 | | | | 0.596 | | |
| YHL016C | | | 0.427 | 0.296 | | | 0.427 | 0.296 |
| YJL093C | | 0.499 | | | | 0.449 | | |
| YJL108C | 0.589 | | | | 0.589 | | | |
| YJL212C | 0.442 | | | 0.461 | 0.442 | | | 0.461 |
| YKR050W | 0.554 | | 0.378 | 0.304 | 0.554 | | 0.378 | 0.304 |
| YLR447C | 0.512 | | | | 0.512 | | | |
| YMR034C | 0.331 | | | 0.316 | 0.331 | | | 0.316 |
| YMR253C | 0.389 | | | 0.375 | 0.389 | | | 0.375 |
| YOL020W | 0.371 | | | | 0.371 | | | |
| YOL075C | 0.494 | | | 0.471 | 0.494 | | | 0.471 |
| YOL077W-A | 0.531 | | | | 0.531 | | | |
| YOL122C | | | | 0.457 | | | | 0.457 |
| YOR079C | 0.552 | | | | 0.552 | | | |
| YOR092W | 0.407 | | | | 0.407 | | | |
| YOR130C | 0.588 | | | | 0.588 | | | |
| YOR222W | 0.469 | | | 0.457 | 0.469 | | | 0.457 |
| YOR291W | | | 0.428 | | | | 0.428 | |
| YOR334W | | | 0.327 | | | | 0.327 | |
| YPL270W | | | 0.375 | | | | 0.375 | |
| YPR003C | 0.400 | | | 0.418 | 0.400 | | | 0.418 |
| YPR058W | | 0.461 | | | | 0.461 | | |
| YPR128C | | 0.342 | | | | 0.342 | | |
| YPR201W | 0.376 | | | 0.353 | 0.376 | | | 0.353 |

TABLE 10

Transport related genes with a 20-40% decrease in Reb A, RebB, RebD or RebM compared to a control steviol glycoside-producing strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides.

| | Transports cal 1; total vs sup | | | | Transport cal 2; ratio sup/total vs total | | | |
|---|---|---|---|---|---|---|---|---|
| | RebA | RebB | RebD | RebM | RebA | RebB | RebD | RebM |
| YCR011C | | | | 0.654 | | | | 0.654 |
| YDL210W | | 0.729 | | | 0.626 | 0.729 | | |
| YDR292C | 0.724 | | | | 0.724 | | | |
| YDR536W | | | | | 0.715 | | | |
| YEL027W | | 0.799 | | | | 0.799 | | |
| YER019C-A | 0.789 | | | | 0.789 | | | |
| YER053C | 0.651 | | | | 0.651 | | | |
| YGR256W | 0.744 | | | | 0.744 | | | |
| YHR002W | 0.795 | | | | 0.795 | | | |
| YJL133W | 0.691 | | | | 0.691 | | | |
| YJL219W | 0.674 | | | | 0.674 | | | |
| YKL016C | 0.627 | | | | 0.627 | | | |
| YKL209C | 0.721 | | | | 0.721 | | | |
| YKR105C | | | | | 0.646 | | | |
| YMR166C | | 0.924 | | | | | | |

TABLE 10-continued

Transport related genes with a 20-40% decrease in Reb A, RebB, RebD or RebM compared to a control steviol glycoside-producing strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides.

| | Transports cal 1; total vs sup | | | | Transport cal 2; ratio sup/total vs total | | | |
|---|---|---|---|---|---|---|---|---|
| | RebA | RebB | RebD | RebM | RebA | RebB | RebD | RebM |
| YNL003C | | 0.814 | | | | | | |
| YOR153W | 0.801 | | | | | | | |
| YOR316C | | | | | | | 0.640 | |
| YOR332W | 0.700 | | | | 0.700 | | | |

Knockouts of YDL210W (SEQ ID NO:25) and YPL270W (SEQ ID NO:79) resulted in decreased RebD excretion in the steviol glycoside-producing strain comprising genes encoding GGPPS, truncated CDPS, KS, KO, ATR2, EUGT11, SrKAHe1, CPR8, UGT85C2, UGT74G1, UGT76G1, and EUGT11 polypeptides and the steviol glycoside-producing strain comprising additional copies of genes encoding GGPPS, truncated CDPS, KS, KO, ATR2, EUGT11, SrKAHe1, CPR8, UGT85C2, UGT74G1, UGT76G1, and EUGT11 polypeptides. As well, knockouts of YJL212C (SEQ ID NO:47) and YOL122C (SEQ ID NO:68) resulted in decreased RebM transport in both strains.

Example 4. Confirmation of Knockout of Yeast Endogenous Transport Genes by Overexpression in a RebD/M-Producing Strain Overexpression of a subset of the initial candidate transporters from Example 3 was performed using both plasmid-based expression and an integration cassette. First, deep-well microtiter plate culture experiments were carried out. Two transport genes were overexpressed using a plasmid in a RebD/M-producing strain in order to confirm the results from the knockout experiments. YGR181W (SEQ ID NO:38), a TIM complex, helper protein for insertion of mitochondrial inner membrane proteins, and YDR061W (SEQ ID NO:26) an ABC-like transporter were overexpressed. The data shown in FIG. 2 demonstrate that the phenotype based on the knockout studies was confirmed with a plasmid based overexpression phenotype for YGR181W (SEQ ID NO:38) and YDR061W (SEQ ID NO:26) in deep-well plates.

Figure 3A:
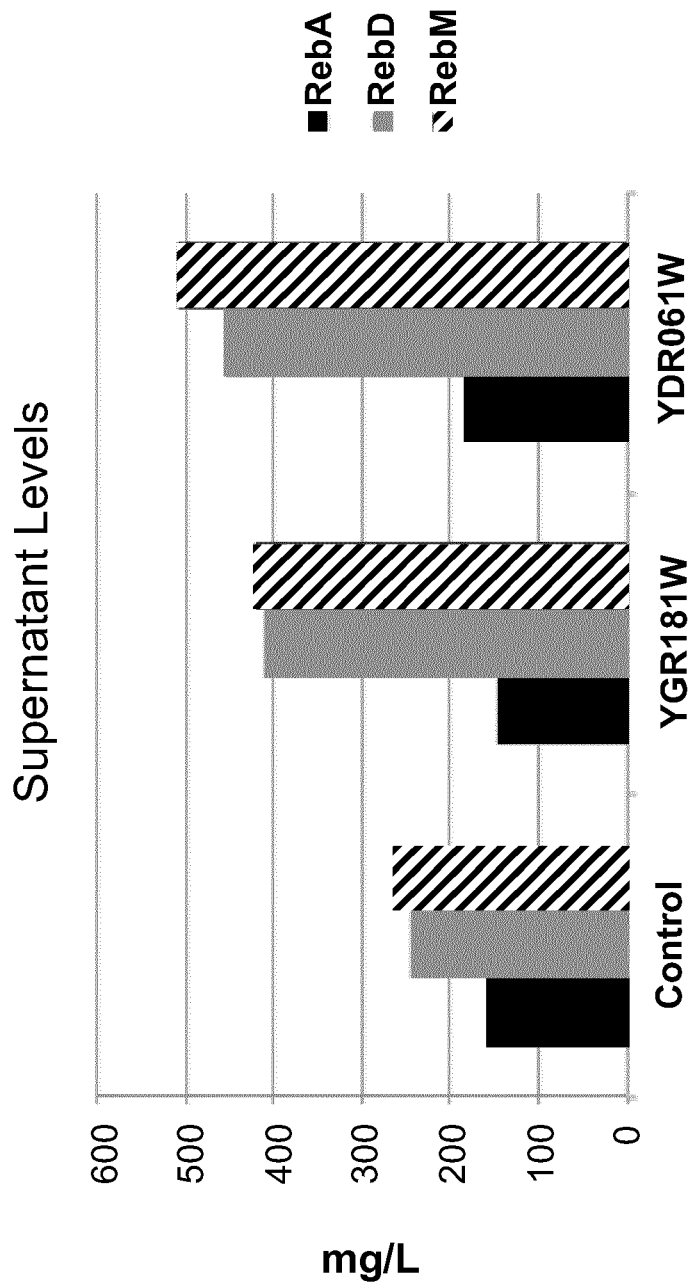
FIG. 3A and FIG. 3B are bar graphs of the amount (mg/L) of RebA, RebD, or RebM in the supernatant (FIG. 3A) or total culture (FIG. 3B) of a YGR181W (SEQ ID NO:38) or YDR061W (SEQ ID NO:26) overexpressing strain, compared to a control steviol glycoside-producing strain. See Example 4.
Figure 3B:
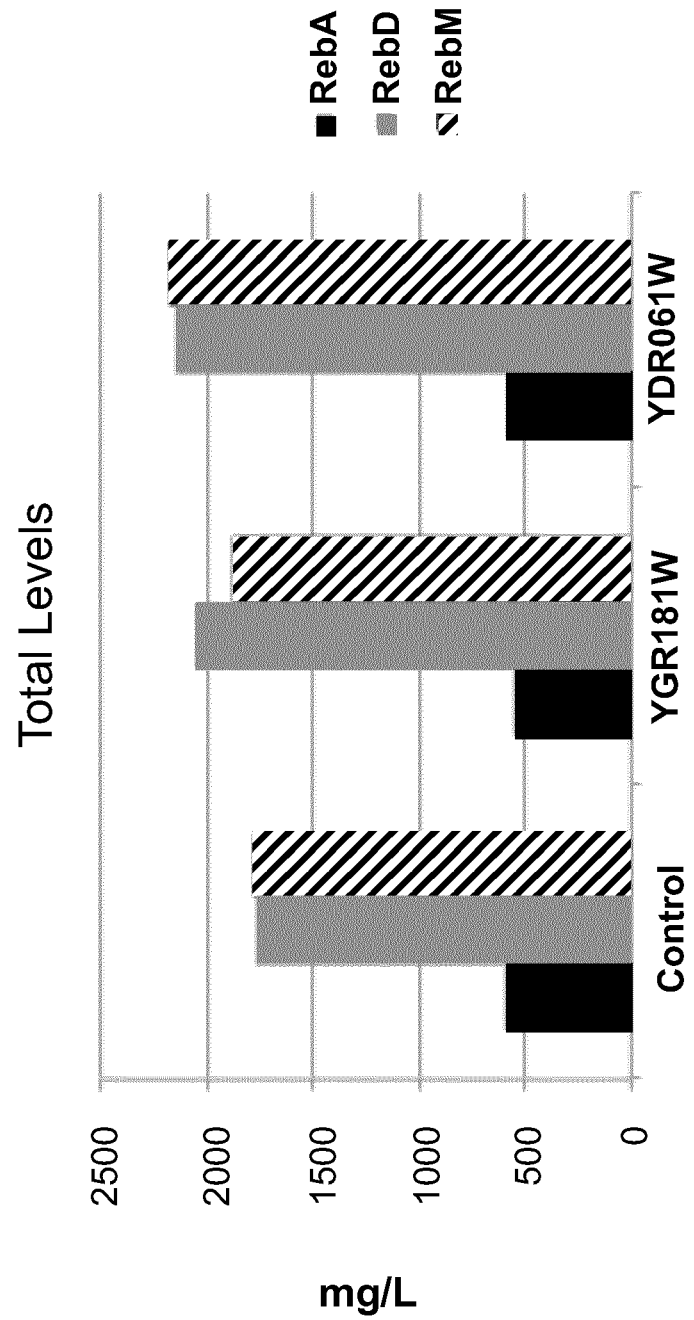

Next, confirmation of the phenotype in fermenters was performed in additional steviol glycoside-producing strains, which were characterized by intergration of YGR181W (SEQ ID NO:38) or YDR061W (SEQ ID NO:26) on chromosome XII. The steviol glycoside-producing strains were grown on defined media at 30° C. in a fed-batch fermentation for about 5 days under glucose-limited conditions, and the levels of RebA, RebB, RebD, and RebM were measured using LC-MS (Method B, Example 1). The graphs shown in FIG. 3 illustrate an approximate 2-fold increase in RebD and RebM transported in the culture medium for the new integration constructs, and little change in RebA and RebB transport. Overexpression of YGR181W (SEQ ID NO:38) or YDR061W (SEQ ID NO:26) resulted in improved (~2-fold) RebD and RebM transport into the culture medium (~400-500 mg/L of supernatant RebD and RebM in YGR181W (SEQ ID NO:38) and YDR061W (SEQ ID NO:26) overexpression strains versus ~250 mg/L of supernatant RebD and RebM in a control steviol glycoside-producing strain). See FIG. 3A. The ratio of transported RebD as compared to the total RebD increased from 0.158 in the control strain to 0.21-0.25 with the candidate genes overexpressed. RebM transport into the culture medium was also simultaneously improved. See FIG. 3.

Example 5. Overexpression of Selected Yeast Endogenous Transport Genes

Overexpression in a steviol glycoside-producing strain (as described in Example 2) using a plasmid with a constitutive promoter of the transporter genes shown in Table 11 resulted in greater than a 20% increase in excretion of RebA, RebB, RebD, and/or RebM. Results were analyzed using criterion 2 described in Example 3. Additionally, overexpression of the transporter genes shown in Table 12 resulted in greater than a 40% improvement in production of RebA, RebB, RebD, and/or RebM. Table 11 shows the supernatant/total ratio for each candidate that fulfills the selection criteria.

TABLE 11

Transport related genes with over a 20% increase in RebA, RebB, RebD or RebM excretion, compared to a control steviol glycoside-producing strain.

| | Ratio Supernatant/Total | | | |
|---|---|---|---|---|
| | RebB | RebA | RebD | RebM |
| YOR079C | | | 1.21 | |
| YMR166C | | 1.36 | 1.53 | 1.38 |
| YEL027W | | 1.62 | 1.82 | 1.52 |
| YDL054C | | 1.45 | 1.38 | 1.31 |
| YKL120W | | 1.83 | 1.89 | 1.93 |
| YDR536W | | 1.79 | 1.80 | 1.76 |
| YBL099W | | | | 1.22 |
| YML116W | | 1.32 | 1.31 | 1.42 |
| YIL166C | | | 1.27 | 1.22 |
| YKR039W | | | 1.26 | 1.41 |
| YOR307C | | | | 1.23 |
| YKL146W | | 1.36 | 1.47 | 1.66 |
| YGL167C | | | | 1.33 |
| YJL093C | | | | 1.29 |
| YOR306C | 1.67 | | | |
| YDL128W | 1.85 | | 1.29 | |
| YOR153W | 1.42 | | 1.21 | |
| YKL050C | 1.59 | 1.22 | | |
| YJL094C | 1.71 | 1.24 | 1.24 | |
| YCL069W | 1.59 | | | |
| YOL158C | 1.52 | | | |
| YFL011W | | | | |
| YJR106W | 1.44 | | 1.38 | 1.33 |
| YBR043C | | | | 1.20 |
| YPR011C | | | | 1.27 |

TABLE 12

Transport related genes with over a 40% increase in RebA, RebB, RebD or RebM production, compared to a control steviol glycoside-producing strain.

| | Increases in Production | | | |
|---|---|---|---|---|
| | RebB | RebA | RebD | RebM |
| YMR166C | | | | 1.52 |
| YIL166C | | 1.41 | 1.50 | 1.55 |
| YKR039W | | | 1.48 | 1.52 |
| YKL146W | | | | 1.42 |
| YJL093C | | | 1.46 | 1.43 |
| YOR306C | | | | 1.59 |
| YDL128W | | | | 1.49 |
| YOL122C | | | 1.41 | 1.59 |
| YIL006W | | | 1.64 | 2.03 |
| YFL028C | | | | 1.55 |
| YBR021W | | | 1.51 | 1.87 |
| YHR002W | | | 1.51 | 1.73 |
| YEL031W | | | 1.45 | 1.66 |
| YCL069W | | | | 1.53 |
| YOL158C | | | 1.42 | 1.63 |
| YKL064W | | | 1.40 | 1.44 |
| YHR096C | | | | 1.42 |
| YOR332W | | | | 1.44 |
| YDR338C | | | 1.50 | 1.55 |
| YJR106W | | | 1.41 | 1.44 |
| YBR043C | | | 1.55 | 1.49 |
| YPR011C | | | | 1.43 |
| YFR045W | | | 1.44 | |

Example 6. Genomic Integration of Transporter Genes

Figure 4C:
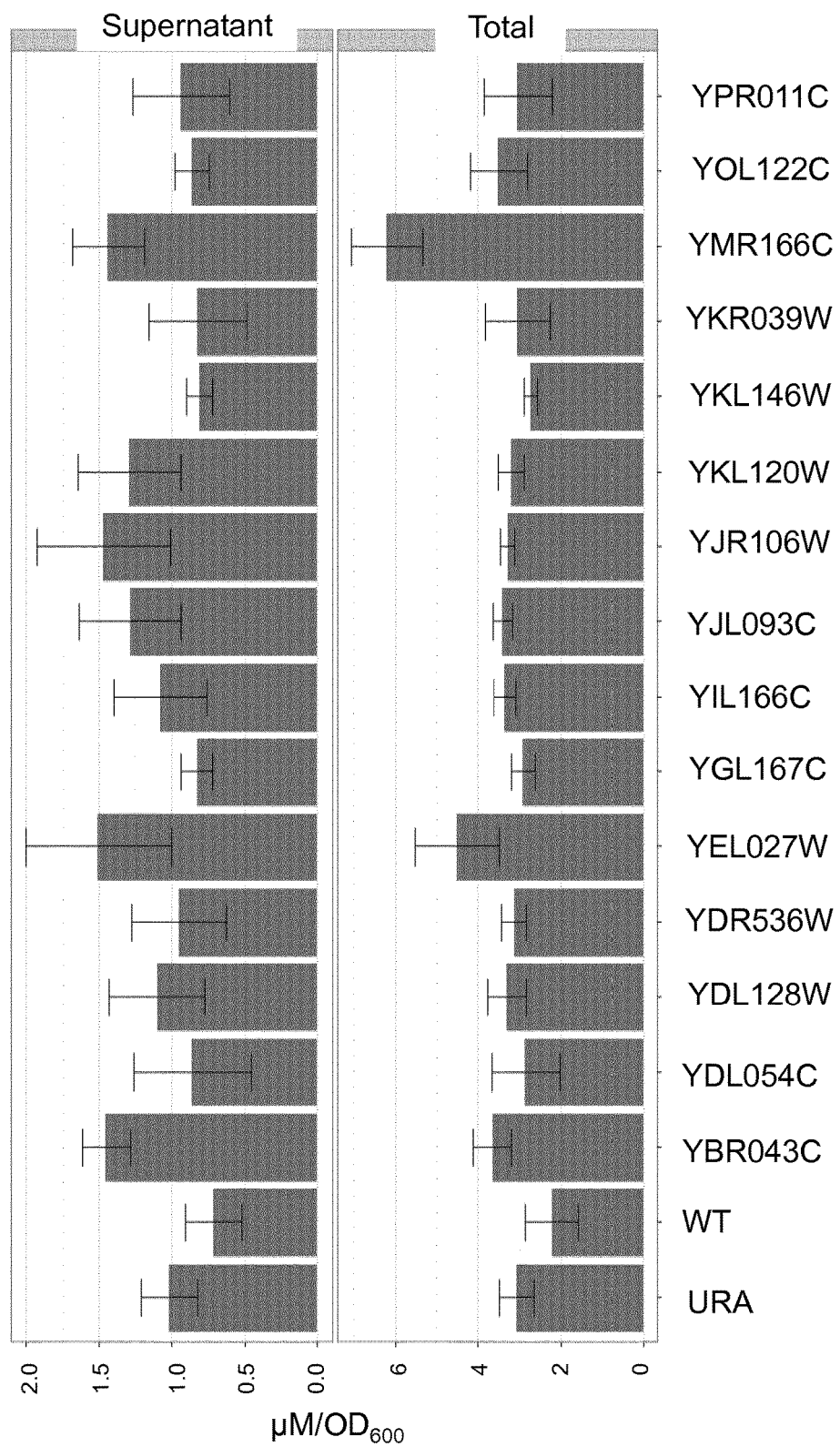
FIG. 4C shows levels of RebB (total levels and supernatant levels; $\mu M/OD_{600}$)
Figure 4E:
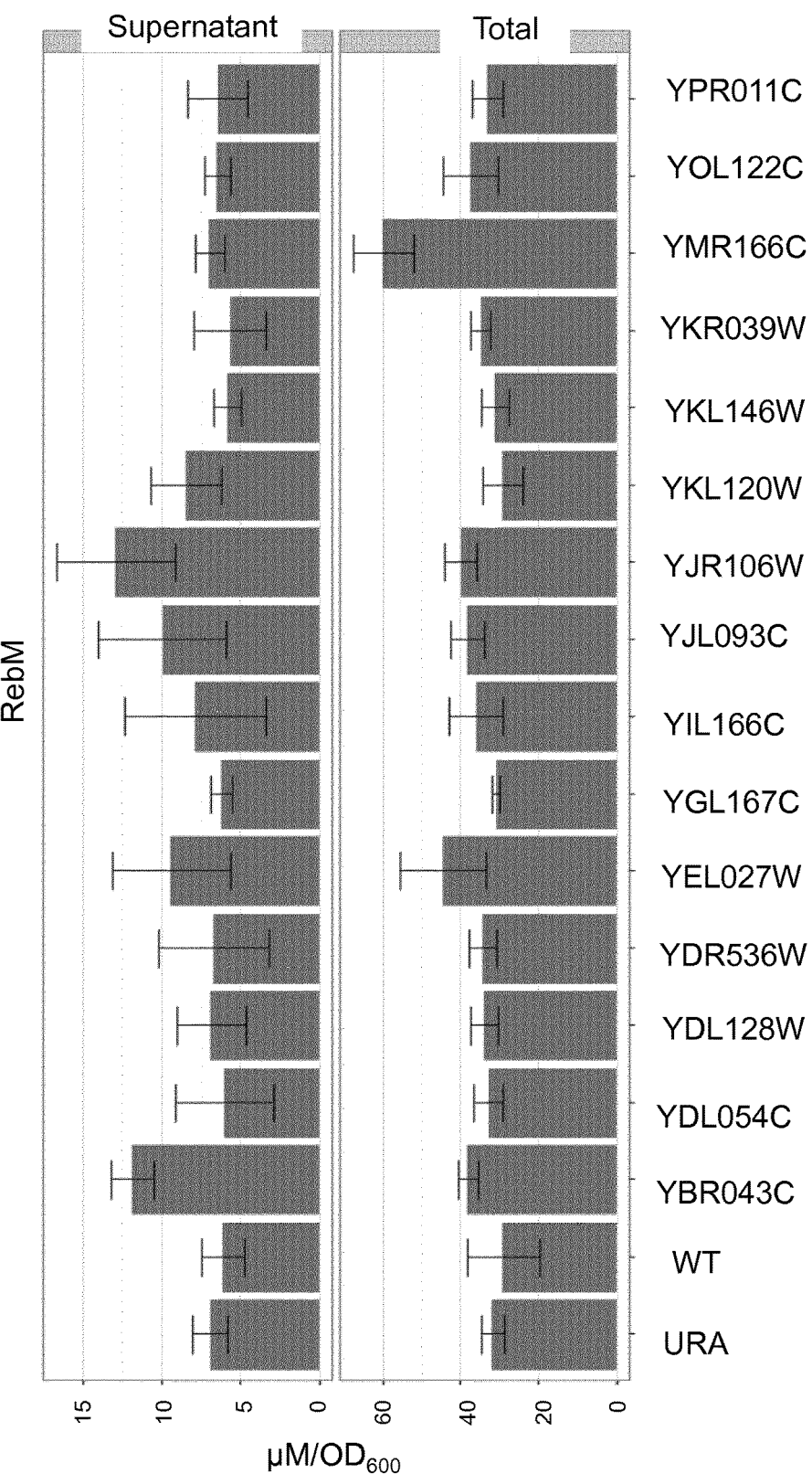
FIG. 4E shows levels of RebM (total levels and supernatant levels; μM/OD$_{600}$) in a steviol glycoside-producing *S. cerevisiae* strain with a genomically integrated transporter gene. The genomically integrated transporter genes of FIGS. 4A-E are YBR043C (SEQ ID NO:88), YEL027W (SEQ ID NO:102), YJL093C (SEQ ID NO:44), YJR106W (SEQ ID NO:48), YMR166C (SEQ ID NO:132), YIL166C (SEQ ID NO:121), YKL120W (SEQ ID NO:126), YDL054C (SEQ ID NO:94), YDL128W (SEQ ID NO:22), YDR536W (SEQ ID NO:30), YGL167C (SEQ ID NO:112), YKL146W (SEQ ID NO:127), YKR039W (SEQ ID NO:129), YOL122C (SEQ ID NO:68), and YPR011C (SEQ ID NO:82). See Example 6.

DNA of the transporter genes selected for integration into the genome of a RebD/M-producing *S. cerevisiae* strain (see Example 2) was amplified from an S288C background by PCR and cloned into a plasmid with homology regions for the integration site and a PGK1 promoter for overexpression, using the USER cloning system. See, e.g., Nour-Eldin et al., 2010, Methods Mol Biol. 643:185-200. The USER cloning construct including the homology regions and the transporter was cut out from the plasmid using restriction enzymes, and the linear piece of DNA was integrated into the genome of the receiving RebD/M-producing strain by standard LiAc method. The genomically integrated transporters were tested in plates that release glucose from a polymer after addition of a growth medium. A polymer that releases 20 g/L glucose over 3 days was used to mimic the feed profile during fermentation. Steviol glycoside levels were measured by LC-MS (see Example 1), and $OD_{600}$ was measured on a Perkin Elmer 2104 Multilabel reader. YBR043C (SEQ ID NO:88), YEL027W (SEQ ID NO:102), YJL093C (SEQ ID NO:44), YJR106W (SEQ ID NO:48), YKL120W (SEQ ID NO:126), and YMR166C (SEQ ID NO:132) showed improved excretion of 13-SMG. (FIG. 4A). YBR043C (SEQ ID NO:88), YEL027W (SEQ ID NO:102), and YMR166C (SEQ ID NO:132) showed improved excretion of RebA (FIG. 4B). YBR043C (SEQ ID NO:88), YEL027W (SEQ ID NO:102), and YMR166C (SEQ ID NO:132) showed improved excretion of RebB (FIG. 4C). YBR043C of SEQ ID NO:88, YEL027W of SEQ ID NO:102, YJL093C of SEQ ID NO:44, YJR106W of SEQ ID NO:48, and YMR166C of SEQ ID NO:132 showed improved production of RebD, and YBR043C of SEQ ID NO:88, YEL027W of SEQ ID NO:102, YIL166C (SEQ ID NO:121), YJL093C of SEQ ID NO:44, YJR106W of SEQ ID NO:48, and YMR166C of SEQ ID NO:132 showed improved production of RebM, as measured by an increase in RebD and RebM levels in the supernatant compared to a control steviol glycoside-producing strain. See FIGS. 4D and 4E. Controls with a URA marker are also shown in FIG. 4.

FIG. 5A shows supernatant levels of RebA, RebB, RebD, and RebM of an additional steviol glycoside-producing strain overexpressing YMR166C (SEQ ID NO:132), YEL027W (SEQ ID NO:102), YKL120W (SEQ ID NO:126), YJR106W (SEQ ID NO:48), YJL093C (SEQ ID NO:44), and YBR043C (SEQ ID NO:88) by the USER cloning system. The strain of FIG. 5 comprised a recombinant gene encoding a *Synechococcus* sp. GGPPS polypeptide (SEQ ID NO:1, SEQ ID NO:149), a recombinant gene encoding a truncated *Zea mays* CDPS polypeptide (SEQ ID NO:2, SEQ ID NO:150), a recombinant gene encoding an *A. thaliana* KS polypeptide (SEQ ID NO:3, SEQ ID NO:151), a recombinant gene encoding a recombinant *S. rebaudiana* KO1 polypeptide (SEQ ID NO:4, SEQ ID NO:152), a recombinant gene encoding a KO polypeptide (SEQ ID NO:XX, SEQ ID NO:XX), a recombinant gene encoding an *A. thaliana* ATR2 polypeptide (SEQ ID NO:5, SEQ ID NO:153), a recombinant gene encoding an *O. sativa* EUGT11 polypeptide (SEQ ID NO:12; SEQ ID NO:148), a recombinant gene encoding an SrKAHe1 polypeptide (SEQ ID NO:6, SEQ ID NO:154), a recombinant gene encoding an *S. rebaudiana* CPR8 polypeptide (SEQ ID NO:7, SEQ ID NO:155), a recombinant gene encoding an *S. rebaudiana* UGT85C2 polypeptide (SEQ ID NO:8, SEQ ID NO:156), a recombinant gene encoding an *S. rebaudiana* UGT74G1 polypeptide (SEQ ID NO:9, SEQ ID NO:157), a recombinant gene encoding an *S. rebaudiana* UGT76G1 polypeptide (SEQ ID NO:10, SEQ ID NO:158), and a recombinant gene encoding an *S. rebaudiana* UGT91D2 variant (or functional homolog), UGT91D2e-b (SEQ ID NO:11, SEQ ID NO:159) polypeptide. FIG. 5B shows total levels of RebA, RebB, RebD, and RebM of the above described steviol glycoside-producing strain overexpressing YMR166C (SEQ ID NO:132), YEL027W (SEQ ID NO:102), YKL120W (SEQ ID NO:126), YIL166C (SEQ ID NO:132), YJR106W (SEQ ID NO:48), YJL093C (SEQ ID NO:44), and YBR043C (SEQ ID NO:88) by the USER cloning system.

Example 7. Production of RebD and RebM by Fermentation of Steviol Glycoside-Producing *S. cerevisiae* Strains Overexpressing YJL093C or YBR043C YJL093C (SEQ ID NO:44) and YBR043C (SEQ ID NO:88) were individually overexpressed in the steviol glycoside-producing strain described in Example 3. The strains were cultivated by fermentation (fed-batch, minimum medium, glucose-limiting) for approximately 130 h. Production of RebD and RebM was measured by LC-MS. As shown in Table 13, the strains overexpressing YJL093C or YBR043C produced higher levels of RebD and RebD+RebM, as compared to a control steviol glycoside-producing strain.

TABLE 13

Production of RebD and RebM in *S. cerevisiae* strains overexpressing YJL093C and YBR043C.

| Strain | Ferm. Length (h) | Final Cell Dry Weight | RebD Titer (g/L) | RebM Titer (g/L) | RebD + RebM | RebD/RebM Ratio (g/g) |
|---|---|---|---|---|---|---|
| Control | 126.83 | 104.53 | 1.38 | 4.47 | 5.85 | 0.31 |
| YJL093C | 130.10 | 114.40 | 3.42 | 2.80 | 6.22 | 1.22 |
| YBR043C | 129.17 | 112.00 | 3.56 | 2.72 | 6.28 | 1.31 |

TABLE 14

Sequences disclosed herein.

```
SEQ ID NO: 1
Synechococcus sp. GGPPS (GenBank ABC98596.1)
atggtcgcac aaactttcaa cctggatacc tacttatccc aaagacaaca acaagttgaa    60
gaggccctaa gtgctgctct tgtgccagct tatcctgaga gaatatacga agctatgaga   120
tactccctcc tggcaggtgg caaaagatta agacctatct tatgtttagc tgcttgcgaa   180
ttggcaggtg gttctgttga acaagccatg ccaactgcgt gtgcacttga aatgatccat   240
acaatgtcac taattcatga tgacctgcca gccatggata acgatgattt cagaagagga   300
aagccaacta atcacaaggt gttcgggaa gatatagcca tcttagcggg tgatgcgctt    360
ttagcttacg ctttttgaaca tattgcttct caaacaagag gagtaccacc tcaattggtg   420
ctacaagtta ttgctagaat cggacacgcc gttgctgcaa caggcctcgt tggaggccaa   480
gtcgtagacc ttgaatctga aggtaaagct atttccttag aaacattgga gtatattcac   540
tcacataaga ctggagcctt gctggaagca tcagttgtct caggcggtat tctcgcaggg   600
gcagatgaag agcttttggc cagattgtct cattacgcta gagatatagg cttggctttt   660
caaatcgtcg atgatatcct ggatgttact gctacatctg aacagttggg gaaaaccgct   720
ggtaaagcag aggcagccgc aaaggcaact tatccaagtc tattgggttt agaagcctct   780
agacagaaag cggaagagtt gattcaatct gctaaggaag ccttaagacc ttacggttca   840
caagcagagc cactcctagc gctggcagac ttcatcacac gtcgtcagca taa           894

SEQ ID NO: 2
Zea mays truncated CDPS
atggcacagcaca catcagaatc cgcagctgtc gcaaagggca gcagtttgac ccctatagtg    60
agaactgacg ctgagtcaag gagaacaaga tggccaaccg atgacgatga cgccgaacct   120
ttagtggatg agatcagggc aatgcttact tccatgtctg atggtgacat ttccgtgagc   180
gcatacgata cagcctgggt cggattggtt ccaagattag acggcggtga aggtcctcaa   240
tttccagcag ctgtgagatg gataagaaat aaccagttgc ctgacggaag ttggggcgat   300
gccgcattat tctctgccta tgacaggctt atcaataccc ttgcctgcgt tgtaactttg   360
acaaggtggt ccctagaacc agagtgagaa ggtagaggac tatctttttt gggtaggaac   420
atgtggaaat tagcaactga agatgaagag tcaatgccta ttggcttcga attagcattt   480
ccatctttga tagagcttgc taagagccta ggtgtccatg acttcccttta tgatcaccag   540
gccctacaag gaatctactc ttcaagagag atcaaaatga gaggattcc aaaagaagtg    600
atgcataccg ttccaacatc aatattgcac agtttggagg gtatgcctgg cctagattgg   660
gctaaactac ttaaactaca gaggagcgac ggaagttttt tgttctcaca agctgccact   720
gcatatgctt taatgaatac cggagatgac aggtgttttta gctacatcga tagaacagta   780
aagaaattca acggcggcgt ccctaatgtt tatccagtgg atctatttga acatatttgg   840
gccgttgata gacttgaaag attaggaatc tccaggtact tccaaaagga gatcgaacaa   900
tgcatgatt atgtaaacag gcattggact gaggacggta tttgttgggc aaggaactct    960
gatgtcaaag aggtggacga cacagctatg gcctttagac ttcttaggtt gcacggctac   1020
agcgtcagtc ctgatgtgtt taaaaacttc gaaaaggacg tgaattttt cgcatttgtc   1080
ggacagtcta atcaagctgt taccggtatg tacaacttaa acagagcaag ccagatatcc   1140
ttcccaggcg aggatgtgct tcatagagct ggtgccttct catatgagtt cttgaggaga   1200
aaagaagcag agggagcttt gagggacaag tggatcattt ctaaagatct acctggtgaa   1260
gttgtgtata ctttggattt tccatggtac ggcaacttac ctagagtcga ggccagagac   1320
tacctagagc aatacggagg tggtgatgac gtttggattg caagacattt gtataggatg   1380
ccacttgtaa acaatgatgt atatttgaaa ttggcaagaa tggattaaa ccactgccag   1440
gctttgcatc agttagagtg gcaaggacta aaaagatggt atactgaaaa taggttgatg   1500
gactttggtg tcgcccaaga agatgcccct agagcttatt tcttgcagc cgcatctgtt   1560
tacgagcctt gtagagctgc cgagaggctt gcatgggcta gagccgcaat actagctaac   1620
gccgtgagca cccacttaag aaatagccca tcattcagag aaaggttaga gcattctctt   1680
aggtgtagac ctagtgaaga cagatggc tcctggttta actcctcaag tggctctgat   1740
gcagttttag taaaggctgt cttaagactt actgattcat tagccaggga agcacagcca   1800
atccatggag gtgacccaga agatattata cacaagttgt taagatctgc ttgggccgag   1860
tgggttaggg aaaaaggcaga cgctgccgat agcgtgtgca atggtagttc tgcagtagaa   1920
caagagggat caagaatggt ccatgataaa cagacctgtc tattattggc tagaatgatc   1980
gaaatttctg ccggtagggc agctggtgaa gcagccagtg aggacggcga tagaagaata   2040
attcaattaa caggctccat ctgcgacagt cttaagcaaa aatgctagt tcacaggac    2100
cctgaaaaaa atgaagagat gatgtctcac gtggatgacg aattgaagtt gaggattaga   2160
gagttcgttc aatatttgct tagactaggt gaaaaaaaga ctggatctag cgaaaccagg   2220
caaacatttt taagtatagt gaaatcatgt tactatgctg ctcattgccc acctcatgtc   2280
gttgatagac acattagtag agtgattttc gagccagtaa gtgccgcaaa gtaaccgcgg   2340

SEQ ID NO: 3
Arabidopsis thaliana KS (similar to GenBank AEE36246.1)
atgtctatta atttgagatc ttccggttgt agctccccaa taagcgcaac tttggaaagg    60
ggtctagact ctgaagttca acaagagca acaatgtat cttttgagca gaccaaagag    120
aagatcagga aaatgcttga gaaggtcgag ttgagcgtga gtgcctatga cactagttgtg   180
gtagctatgg tcccatcacc atccagtcaa aacgcacctc tttcccaca gtgcgtcaaa    240
tggctacttg ataatcaaca tgaggacggc tcttggggat tggataacca cgaccatcag   300
agcttaaaga aagatgtgtt gtcatccaca ttagcctcta tcctagctct taagaaatgg   360
ggataggcg aaagacagat caataagggt ctacagttca ttgaattaaa tctcgcacta   420
gttaccgatg aaactataca aaaacctaca ggtttcgaca tcattttttcc aggaatgalt   480
aagtacgcca gggaccttaa tttgaccata cctcttggct cagaagtagt cgacgatatg   540
atcaggaaaa agatctagaa cttaaagtgt gatagcgaga aattcagcaa aggtagagag   600
gcttatcttg cctatgttct tgaaggaact aggaacttga aggactggga cttaattgtg   660
aaatatcaga gaaagaacgg tagtctattt gatagtccag ctacaaccgc cgcagctttc   720
actcaatttg gcaatgacgg ttgcttgagg tacttatgtt cactttttaca gaaattcgag   780
gccgcagtgc ctagtgtata tccatttgat caatacgcta gattaagcat aatcgtcact   840
ttagaatcat tgggaattga cagagatttc aagactgaga taaaaagcat attggatgag   900
acctataggt actggcttag aggtgacgaa gaaatttgcc tagatttggc cacatgtgca   960
```

TABLE 14-continued

Sequences disclosed herein.

```
cttgctttta ggttgctttt agcccacggc tatgacgtgt catacgatcc tctaaagcca    1020
tttgcagagg aatctggttt cagcgatacc cttgagggat atgttaaaaa cacctttttcc   1080
gtattagagc ttttcaaggc tgcccaaagt taccctcatg agagtgcttt gaaaaagcag    1140
tgttgctgga caaaacaata tctagaaatg aactaagtt catgggttaa aacaagcgtt     1200
agggacaagt acttgaaaaa ggaagtggag gatgctttgg catttccatc atatgcctct    1260
ttaaaaagaa gtgaccacag aaggaaaatt cttaatggct cagcagttga aaacacaaga    1320
gtaaccaaga cctcttacag gttgcataat atatgtacat cagatatctt aaaacttgct   1380
gtcgacgatt tcaacttttg ccaatctatt catagagagg aaatggaaag attggataga    1440
tggatagtgg agaatagact acaggaatta aagttcgcca gacaaaaatt ggcttactgt    1500
tactttagtg gcgctgccac actattctct ccagaattgc tgacgcaag gatctcatgg     1560
gctaagggag gtgttctaac cacagtagtc gatgactttt ttgatgttgg cggtagtaaa    1620
gaagagcttg agaacttaat tcacttggtg caaaagtggg atcttaatgg agttcctgaa    1680
tactcttcag agcatgtaga aataattttc tctgtcctaa gagacactat cttagaaacc    1740
ggtgataaag cctttacata tcagggcaga aacgttactc accatattgt gaaaatatgg    1800
ttggacttac ttaagagcat gctaagggag gctgaatggt ccagtgacaa atcaaccca    1860
tctttggaag attacatgga gaatgcctat atcagcttcg cattaggtcc tattgtattg    1920
ccagctacat accttatagg acctccacta cctgaaaaga ctgtcgactc ccaccaatat    1980
aatcaattat acaaattggt tagtaccatg ggtagactat aaacgatat ccagggctt      2040
aagagggaat cagccgaggg aaaacttaat gcagtgtctc tacatatgga gcatgaaaga   2100
gacaacagaa gcaaagaggt tattatagaa tccatgaaag gattggctga aggaaaaga    2160
gaggaattac acaaacttgt actagaagag aaggtagtg tcgttccaag agaatgcaag    2220
gaagccttct taaaaatgtc aaaagtgttg aaccttttt ataggaagga tgatggcttc     2280
acatctaacg acttgatgag ccttgtgaaa tccgtcatct acgagcctgt ttcacttcaa    2340
aaggagagtc taacttga                                                   2358

SEQ ID NO: 4
S. rebaudiana KO1 (codon optimized)
atggatgctg tgacgggttt gttaactgtc ccagcaaccg ctataactat tggtggaact      60
gctgtagcat tggcggtagc gctaatcttt tggtacctga atcctacac atcagctaga     120
agatcccaat caaatcatct tccaagagtg cctgaagtcc caggtgttcc attgttagga     180
aatctgttac aattgaagga gaaaaagcca tacatgactt ttacgagatg ggcagcgaca     240
tatggaccta tctatagtat caaaactggg gctacaagta tggttgtggt atcatctaat     300
gagatagcca aggaggcatt ggtgaccaga ttccaatcca tatctacaag gaacttatct     360
aaagccctga agtacttac agcagataag acaatggtcg caatgtcaga ttatgatgat     420
tatcataaaa cagttaagag acacatactg accgccgtct gggtcctaa tgcacagaaa      480
aagcatagaa ttcacagaga tatcatgatg gataacatat ctactcaact tcatgaattc     540
gtgaaaaaca acccagaaca ggaagaggta gaccttagaa aaatcttca atctgagtta     600
ttcggcttag ctatgagaca agccttagga aaggatgttg aaagtttgta cgttgaagac     660
ctgaaaatca ctatgaatag acgaaatc tttcaagtcc ttgttgttga tccaatgatg       720
ggagcgatcg atgttgattg gagagacttc tttccatacc taagtgggt cccaaacaaa     780
aagttcgaaa atactattca caaatgtac atcagaagag aagctgttat gaaatcttta     840
atcaaagagc acaaaagag aatagcgtca ggcgaaaagc taaatagtta tatcgattac      900
ctttatctg aagctcaaac tttaaccgat cagcaactat tgatgtcctt gtgggaacca      960
atcattgaat cttcagatac aacaatggtc acaacagaat gggcaatgta cgaattagct    1020
aaaaacccta aattgcaaga taggttgtac agagacatta gtccgtctg tggatctgaa    1080
aagataaccg aagagcatct atcacagctg ccttacatta cagctatttt ccacgaaaca   1140
ctgagaagac actcaccagt tcctatcatt cctctaagac atgtacatga agataccgtt    1200
ctaggcggct accatgttcc tgctggcaca gaacttgccg ttaacatcta cggttgcaac    1260
atggacaaaa acgtttggga aaatccagag gaatggaacc agaaagatt catgaaagag    1320
aatgagacaa ttgattttca aaagacgatg gccttcggtg gtggtaagag agtttgtgct    1380
ggttccttgc aagcccttt aactgcatct attgggattg ggagaatggt tcaagagttc    1440
gaatggaaac tgaaggatat gactcaagag gaagtgaaca cgataggcct aactacacaa    1500
atgttaagac cattgagagc tattatcaaa cctaggatct aa                       1542

SEQ ID NO: 5
A. thaliana ATR2 (codon optimized)
atgtcttcct cttcctcttc cagtacctct atgattgatt tgatggctgc tattattaaa      60
ggtgaaccag ttatcgtctc cgacccagca aatgcctctg cttatgaatc agttgctgca     120
gaattgtctt caatgttgat cgaaaacaga caattcgcca tgatcgtaac tacatcaatc     180
gctgttttga tcggttgtat tgtcatgttg gtatggaaa gatccggtag tggtaattct     240
aaaagagtcg aacctttgaa accattagta attaagccaa gcgaagaaga aatagatgaa     300
ggtagaaaga aagttacaat attttttggt acccaaactg gtacagctga aggttttgca     360
aaagccttag tgaagaagc taaggcaaga tacgaaaaga ctagattcaa gatagtcgat     420
ttggatgact atgccgctga tgacgatgaa tacgaagaaa agttgaagaa agaagatgtt    480
gcattttttct ttttggcaac ctatggtgac ggtgaaccaa ctgacaatgc agccagattc    540
tacaaatggt ttacagaggg taatgatcgt ggtgaatggt tgaaaaactt aaagtacggt    600
gttttcggtt ggggtaacag acaatacgaa catttcaaca agttgcaaa ggttgtcgac    660
gatattttgt cgaacaagg tgctcaagaa ttagtccaag taggtttggg tgacgatgac    720
caatgtatag aagatgctt tactgcctgg agagaagctt tgtggcctga attagacaa     780
atcttgagag aagaaggtga caccgccgtt gctacccca atactgctgc agtattagaa     840
tacagagttt ccatccatga tagtgaagac gcaaagtta atgatatcac tttggccaat    900
ggtaacggtt atacagtttt cgatgcacaa caccccttaca agctaacgt tgcagtcaag    960
agagaattac ataccaccaga atccgacaga acctgtatac attggaatt tgatatcgtt   1020
ggttccggtt taaccatgaa gttgggtgac catgtaggtg ttttatgcga caatttgtct   1080
gaaactgttg atgaagcatt gagattgttg gatatgtccc ctgacactta ttttagtttg    1140
cacgctgaaa aagaagatgg tacaccaatt tccagttctt taccacctcc attcctcca    1200
tgtaacttaa gaacagcctt gaccagatac gcttgcttgt tatcatcccc taaaagtcc   1260
gccttggttg ctttagccgc tcatgctagt gatcctactg aagcagaaag attgaaacac   1320
```

TABLE 14-continued

Sequences disclosed herein.

```
ttagcatctc cagccggtaa agatgaatat tcaaagtggg tagttgaatc tcaaagatca    1380
ttgttagaag ttatggcaga attccatct gccaagcctc cattaggtgt cttctttgct    1440
ggtgtagcac ctagattgca accaagattc tactcaatca gttcttcacc taagatcgct   1500
gaaactagaa ttcatgttac atgtgcatta gtctacgaaa agatgccaac cggtagaatt    1560
cacaagggtg tatgctctac ttggatgaaa aatgctgttc cttacgaaaa atcagaaaag   1620
ttgttcttag gtagaccaat cttcgtaaga caatcaaact tcaagttgcc ttctgattca    1680
aaggttccaa taatcatgat aggtcctggt acaggtttag ccccattcag aggtttcttg   1740
caagaaagat tggctttagt tgaatctggt gtcgaattag gtccttcagt tttgttcttt   1800
ggttgtagaa acagaagaat ggatttcatc tatgaagaag aattgcaaag attcgtcgaa   1860
tctggtgcat tggccgaatt atctgtagct ttttcaagag aaggtccaac taaggaatac   1920
gttcaacata agatgatgga taaggcatcc gacatatgga acatgatcag tcaaggtgct   1980
tatttgtacg tttgcggtga cgcaaaggggt atggccagag atgtccatag atctttgcac   2040
acaattgctc aagaacaagg ttccatggat agtaccaaag ctgaaggttt cgtaaagaac   2100
ttacaaactt ccggtagata cttgagagat gtctggtga                          2139

SEQ ID NO: 6
Stevia rebaudiana KAHe1 (codon-optimized)
atggaagcct cttacctata catttctatt ttgcttttac tggcatcata cctgttcacc      60
actcaactta gaaggaagag cgctaatcta ccaccaaccg tgtttccatc aataccaatc     120
attggacact tatacttact caaaaagcct ctttataga ctttagcaaa aattgccgct      180
aagtacggac caatactgca attacaactc ggctacagac gtgttctggt gatttcctca     240
ccatcagcag cagaagagtg ctttaccaat aacgatgtaa tcttcgcaaa tagacctaag     300
acattgtttg gcaaaatagt ggggtggaaca tcccttggca gtttatccta cggcgatcaa    360
tggcgtaatc taaggagagt agcttcatc gaaatcctat cagttcatag gttgaacgaa      420
tttcatgata tcagagtgga tgagaacaga ttgttaatta gaaaacttag aagttcatct    480
tctcctgtta ctcttataac agtctttat gctctaacat tgaacgtcat tatgagaatg     540
atctctggca aaagatattt cgacagtggg gatagagaat tggaggagga aggtaagaga     600
tttcgagaaa tcttagacga aacgttgctt ctagccggtg cttctaatgt tggcgactac     660
ttaccaatat tgaactggtt gggagttaag tctcttgaaa agaaattgat cgcttttgcag   720
aaaaagagag atgactttt ccagggtttg attgaacagg ttagaaaatc tcgtggtgct     780
aaagtaggca aaggtagaaa aacgatgatc gaactcttat tatctttgca agagtcagaa   840
cctgagtact atacagatgc tatgataaga tcttttgtcc taggtctgct ggctgcaggt    900
agtgatactc cagcgggcac tatggaatgg gccatgagct tactggtcaa tcacccacat    960
gtattgaaga aagctcaagc tgaaatcgat agagttatcg gtaataacag attgattgac   1020
gagtcagaca ttggaaatat cccttacatc gggtgtatta tcaatgaaac tctaagactc   1080
tatccagcag ggccattgtt gttcccacat gaaagttctg tcgactgcgt tatttccggt   1140
tacaatatac ctagaggtac aatgttaatc gtaaaccaat gggcgattca tcacgatcct   1200
aaagtctygg atgatcctga aacctttaaa cctgaaagat ttcaaggatt agaaggaact   1260
agagatggtt tcaaacttat gccattcggt tctggggagaa gaggatgtcc aggtgaaggt   1320
ttggcaataa ggctgttagg gatgacacta ggctcagtga tccaatgttt tgattgggag   1380
agagtaggag atgagatggt tgacatgaca gaaggtttgg gtgtcacact tcctaaggcc   1440
gttccattag ttgccaaatg taagccacgt tccgaaatga ctaatctcct atccgaactt   1500
taa                                                                 1503

SEQ ID NO: 7
Stevia rebaudiana CPR8
ATGCAATCTAACTCCGTGAAGATTTCGCCGCTTGATCTGGTAACTGCGCTGTTTAGCGGCAAGGTTTT
GGACACATCGAACGCATCGGAATCGGGAGAATCTGCTATGCTGCCGACTATAGCGATGATTATGGAGA
ATCGTGAGCTGTTGATGATACTCACAACGTCGGTTGCTGTATTGATCGGATGCGTTGTCGTTTTGGTG
TGGCGGAGATCGTCTACGAAGAAGTCGGCGTTCGAGCCACCGGTGATTGTGGTTCCGAAGAGAGTGCA
AGAGGAGGAAGTTGATGATGGTAAGAAGAAAGTTACGGTTTTCTTCGGCACCCAAACTGGAACAGCTG
AAGGCTTCGCTAAGGCACTTGTTGAGGAAGCTAAAGCTCGATATGAAAAAGGCTGTCTTTAAAGTAATT
GATTTGCATGATTATGCTGCTGATGACGATGAGTATGAGGAGAAACTAAAGAAAGAATCTTTGGCCTT
TTTCTTTTTGGCTACGTATGGAGATGGTGAGCCAACAGATAATGCTGCCAGATTTTATAAATGGTTTA
CTGAGGGAGATGCGAAAGGAGAATGGCTTAATAAGCTTCAATATGGAGTATTTGGTTTGGGTAACAGA
CAATATGAACATTTTAACAAGATCGCAAAAGTGGTTGATGATGGTCTTGTAGAACAGGGTGCAAAGCG
TCTTGTTCCTGTTGGACTTGGAGATGATGATCAATGTATTGAAGATGACTTCACCGCATGGAAAGAGT
TAGTATGGCCGGAGTTGGATCAATTACTTCGTGATGAGGATGACACAACTGTTGCTACTCCATACACA
GCTGCTGTTGCAGAATATCGCGTTGTTTTCATGAAAAACCAGACGCGGTTTCTGAAGATTATAGTTA
TACAAATGGCCATGCTGTTCATGATGCTCAACATCCATGCAGATCCAACGTGGCTGTCAAAAAGGAAC
TTCATAGTCCTGAATCTGACCGGTCTTGCACTCATCTTGAATTTGACATCTCGAACACCGGACTATCA
TATGAAACTGGGGACCATGTTGGAGTTTACTGTGAAAACTTGAGTGAAGTTGTGAATGATGCTGAAAG
ATTAGTAGGATTACCACCAGACACTTACTCCTCCATCCACACTGATAGTGAAGACGGGTCGCCACTTG
GCGGAGCCTCATTGCCGCCTCCTTTCCCGCCATGCACTTTAAGGAAAGCATTGACGTGTTATGCTGAT
GTTTTGAGTTCTCCCAAGAAGTCGGCTTTGCTTGCACTAGCTGCTCATGCCACCGATCCCAGTGAAGC
TGATAGATTGAAATTTCTTGCATCCCCCGCCGGAAAGGATGAATATTCTCAATGGATAGTTGCAAGCC
AAAGAAGTCTCCTTGAAGTCATGGAAGCATTCCCGTCAGCTAAGCCTTCACTTGGTGTTTTCTTTGCA
TCTGTTGCCCCGCGCTTACAACCAAGATACTACTCTATTTCTTCCTCACCCAAGATGGCACCGGATAG
GATTCATGTTACATGTGCATTAGTCTATGAGAAAACACCTGCAGGCCGCATCCACAAAGGAGTTTGTT
CAACTTGGATGAAGAACGCAGTGCCTATGACCGAGAGTCAAGATTCAGTTGGGCCCCAATATACGTC
CGAACATCCAATTTCAGACTACCATCTGACCCTAAGGTCCCGGTTATCATGATTGGACCTGGCACTGG
TTTGGCTCCTTTTAGAGGTTTCCTTCAAGAGCGGTTAGCTTTAAAGGAAGCCGGAACTGACCTCGGTT
TATCCATTTTATTCTTCGGATGTAGGAATCGCAAAGTGGATTTCATATATGAAAACGAGTTTAACAAC
TTTGTGGAGACTGGTGCTCTTTCTGAGCTTATTGTTGCTTTCTCCCGTGAAGGCCCGACTAAGGAATA
TGTGCAACACAAGATGAGTGAGAAGGCTTCGGATATCTGGACTTGCTTTCTGAAGGAGCATATTTAT
ACGTATGTGGTGATGCCAAAGGCATGGCCAAAGATGTACATCGAACCCTCCACACAATTGTGCAAGAA
CAGGGATCTCTTGACTCGTCAAAGGCAGAACTCTACGTGAAGAATCTACAAATGTCAGGAAGATACCT
CCGTGACGTTTGGTAA
```

TABLE 14-continued

Sequences disclosed herein.

SEQ ID NO: 8
*Stevia rebaudiana* UGT85C2 (codon optimized)

| | | | | | |
|---|---|---|---|---|---|
| atggatgcaa | tggcaactac | tgagaaaaag | cctcatgtga | tcttcattcc | atttcctgca | 60 |
| caatctcaca | taaaggcaat | gctaaagtta | gcacaactat | tacaccataa | gggattacag | 120 |
| ataactttcg | tgaataccga | cttcatccat | aatcaatttc | tggaatctag | tggccctcat | 180 |
| tgtttggacg | gagccccagg | gtttagattc | gaaacaattc | ctgacggtgt | ttcacattcc | 240 |
| ccagaggcct | ccatcccaat | aagagagagt | ttactgaggt | caatagaaac | caacttttg | 300 |
| gatcgtttca | ttgacttggt | cacaaaactt | ccagacccac | caacttgcat | aatctctgat | 360 |
| ggctttctgt | cagtgtttac | tatcgacgct | gccaaaaagt | tgggtatccc | agttatgatg | 420 |
| tactggactc | ttgctgcatg | cggtttcatg | ggtttctatc | acatccattc | tcttatcgaa | 480 |
| aagggttttg | ctccactgaa | agatgcatca | tacttaacca | acggctacct | ggatactgtt | 540 |
| attgactggg | taccaggtat | ggaaggtata | agacttaaag | attttccttt | ggattggtct | 600 |
| acagacctta | atgataaagt | attgatgttt | actacagaag | ctccacaaag | atctcataag | 660 |
| gtttcacatc | atatctttca | cacctttgat | gaattggaac | catcaatcat | caaaaccttg | 720 |
| tctctaagat | acaatcatat | ctacactatt | ggtccattac | aattacttct | agatcaaatt | 780 |
| cctgaagaga | aaaagcaaac | tggtattaca | tccttacacg | gctactcttt | agtgaaagag | 840 |
| gaaccagaat | gttttcaatg | gctacaaagt | aaagagccta | attctgtggt | ctacgtcaac | 900 |
| ttcggaagta | caacagtcat | gtccttggaa | gatatgactg | aatttggttg | gggccttgct | 960 |
| aattcaaatc | attactttct | atggattatc | aggtccaatt | tggtaataga | ggaaaacgcc | 1020 |
| gtattacctc | cagaattgga | ggaacacatc | aaaaagagag | gtttcattgc | ttcctggtgt | 1080 |
| tctcaggaaa | aggtattgaa | acatccttct | gttggtggtt | tccttactca | ttgcggttgg | 1140 |
| ggctctacaa | tcgaatcact | aagtgcagga | gttccaatga | tttgttggcc | atattcatgg | 1200 |
| gaccaactta | caaattgtag | gtatatctgt | aaagagtggg | aattggatt | agaaatggga | 1260 |
| acaaaggtta | aacgtgatga | agtgaaaaga | ttggttcagg | agttgatggg | ggaaggtggc | 1320 |
| cacaagatga | gaaacaaggc | caaagattgg | aaggaaaaag | ccagaattgc | tattgctcct | 1380 |
| aacgggtcat | cctctctaaa | cattgataag | atggtcaaag | agattacagt | cttagccaga | 1440 |
| aactaa | | | | | | 1446 |

SEQ ID NO: 9
*S. rebaudiana* UGT74G1 (GenBank AAR06920.1)

| | | | | | |
|---|---|---|---|---|---|
| atggcggaac | aacaaaagat | caagaaatca | ccacacgttc | tactcatccc | attcccttta | 60 |
| caaggccata | taaacccttt | catccgagttt | ggcaaacgat | taatctccaa | aggtgtcaaa | 120 |
| acaacacttg | ttaccaccat | ccacacctta | aactcaaccc | taaaccacag | taacaccacc | 180 |
| accacctcca | tcgaaatcca | agcaatttcc | gatggttgtg | atgaaggcgg | ttttatgagt | 240 |
| gcaggagaat | catatttgga | aacattcaaa | caagttgggt | ctaaatcact | agctgactta | 300 |
| atcaagaagc | ttcaaagtga | aggaaccaca | attgatgcaa | tcatttatga | tctctatgact | 360 |
| gaatgggttt | tagatgttgc | aattgagttt | ggaatcgatg | gtggttcgtt | tttcactcaa | 420 |
| gcttgtgttg | taaacagctt | atattatcat | gttcataagg | gtttgatttc | tttgccattg | 480 |
| ggtgaaactg | tttcggttcc | tggatttcca | gtgcttcaac | ggtyggagac | accgttaatt | 540 |
| ttgcagaatc | atgagcaaat | acagaccct | tggtctcaga | tgttgtttgg | tcagtttgct | 600 |
| aatattgatc | aagcacgttg | ggtcttcaca | aatagttttt | acaagctcga | ggaagaggta | 660 |
| atagagtgga | cgagaaagat | atggaacttg | aaggtaatcg | ggccaacact | tccatccatg | 720 |
| taccttgaca | acgacttga | tgatgataaa | gataacggat | taatctcta | caaagcaaac | 780 |
| catcatgagt | gcatgaactg | gttagacgat | aagccaaagg | aatcagttgt | ttacgtagca | 840 |
| tttggtagcc | tggtgaaaca | tggacccgaa | caagtggaaa | aatcacacg | ggcttttata | 900 |
| gatagtgatg | tcaacttctt | gtgggttatc | aaacataaag | aagagggaaa | gctcccagaa | 960 |
| aatctttcgg | aagtaataaa | aaccggaaag | ggttttgattg | tagcatggtg | caaacaattg | 1020 |
| gatgtgttag | cacacgaatc | agtaggatgc | tttgttacac | attgtgggtt | caactcaact | 1080 |
| cttgaagcaa | taagtcttgg | agtccccgtt | gttgcaatgc | ctcaattttc | ggatcaaact | 1140 |
| acaaatgcca | agcttctaga | tgaaattttg | ggtgttggag | ttagagttaa | ggctgatgag | 1200 |
| aatgggatag | tgagaagagg | aaatcttgcg | tcatgtatta | agatgattat | ggaggaggaa | 1260 |
| agaggagtaa | taatccgaaa | gaatgcggta | aaatggaagg | atttggctaa | agtagccgtt | 1320 |
| catgaaggtg | gtagctcaga | caatgatatt | gtcgaatttg | taagtgagct | aattaaggct | 1380 |
| taaattttg | ttgctttgta | ttttatgtgt | tatggttttt | tgatttagat | gtattcaatt | 1440 |
| aatattgaat | cataactaaa | ttcaagatta | ttgtttgtaa | tattctttgt | cctaaaatttt | 1500 |
| tgcgacttaa | aaccttttagt | ttataaaaag | aaattagaaa | atactattgc | acgga | 1555 |

SEQ ID NO: 10
*S. rebaudiana* UGT76G1 (codon optimized)

| | | | | | |
|---|---|---|---|---|---|
| atggaaaaca | agaccgaaac | aacagttaga | cgtaggcgta | gaatcattct | gtttccagta | 60 |
| ccttttcaag | ggcacatcaa | tccaatacta | caactagcca | acgttttgta | ctctaaaggt | 120 |
| ttttctatta | caatctttca | caccaatttc | aacaaaccaa | aacatccaa | ttacccacat | 180 |
| ttcacattca | gattcatact | tgataatgat | ccacaagatg | aacgtatttc | aaacttacct | 240 |
| acccacggtc | ctttagctgg | aatgagaatt | ccaatcatca | atgaacatgg | tgccgatgag | 300 |
| cttagaagag | aattagagtt | acttatgttg | gcatccgaag | aggacgagga | agtctcttgt | 360 |
| ctgattactg | acgctctatg | gtactttgcc | caatctgtgg | ctgatagttt | gaatttgagg | 420 |
| agattggtac | taatgacatc | cagtctgttt | aactttcacg | ctcatgttag | tttaccacaa | 480 |
| tttgacgaat | tgggatactt | ggaccctgat | gacaagacta | ggttagagga | acaggcctct | 540 |
| ggttttccta | tgttgaaagt | caaagatatc | aagtctgcct | attctaattg | gcaaatcttg | 600 |
| aaagagatct | taggaaagat | gatcaaacag | acaaaggctt | catctggagt | gatttggaac | 660 |
| agtttcaagg | agttagaaga | gtctgaattg | gagactgtaa | tcagagaaat | tccagcacct | 720 |
| tcattcctga | taccattacc | aaaacatttg | actgcttcct | cttcctcttt | gttggatcat | 780 |
| gacagaacga | ttttcaatg | gttggaccaa | caaccaccta | gttctgtttt | gtacgtgtca | 840 |
| tttggtagta | cttctgaagt | cgatgaaaag | gacttccttg | aaatcgcaag | aggcttagtc | 900 |
| gatagtaagc | agtcattcct | ttgggtcgtg | cgtccaggtt | tcgtgaaagg | ctcaacatgg | 960 |
| gtcgaaccac | ttccagatgg | ttttctaggc | gaaagaggta | gaatagtcaa | atgggttcct | 1020 |

TABLE 14-continued

Sequences disclosed herein.

```
caacaggaag tttttagctca tggcgctatt ggggcattct ggactcattc cggatggaat    1080
tcaactttag aatcagtatg cgaagggta  cctatgatct tttcagattt tggtcttgat    1140
caaccactga acgcaagata catgtctgat gttttgaaag tgggtgtata tctagaaaat    1200
ggctgggaaa ggggtgaaat agctaatgca ataagacgtg ttatggttga tgaagagggg    1260
gagtatatca gacaaaacgc aagagtgctg aagcaaaagg ccgacgtttc tctaatgaag    1320
ggaggctctt catacgaatc cttagaatct cttgtttcct acatttcatc actgtaa      1377
```

SEQ ID NO: 11
*S. rebaudiana* UGT91D2e-b (codon optimized)
```
atggctactt ctgattccat cgttgacgat agaaagcaat gcatgttgc  tacttttcca     60
tggttggctt tcggtcatat tttgccatac ttgcaattgt ccaagttgat tgctgaaaag    120
ggtcacaagg tttcattctt gtctaccacc agaaacatcc aaagattgtc ctctcatatc    180
tccccattga tcaacgttgt tcaattgact ttgccaagag tccaagaatt gccagaagat    240
gctgaagcta ctactgatgt tcatccagaa gatatccctt acttgaaaaa ggcttccgat    300
ggtttacaac cagaagttac tagattcttg aacaacatcc cccagattg  gatcatctac    360
gattatactc attactggtt gccatccatt gctgcttcat tgggtatttc tagagcccat    420
ttctctgtta ctactccatg ggctattgct tatatgggtc catctgctga tgctatgatt    480
aacggttctg atggtagaac taccgttgaa gatttgacta ctccaccaaa gtggtttcca    540
tttccaacaa aagtctgttg gagaaaacac gatttggcta gatggttcc  atacaaagct    600
ccaggtattt ctgatggtta cagaatgggt atggttttga aaggttccga ttgcttgttg    660
tctaagtgct atcatgaatt cggtactcaa tggttgcctt gttgaaaac  attgcatcaa    720
gttccagttg ttccagtagg tttgttgcca ccagaaattc aggtgacga  aaaagacgaa    780
acttgggttt ccatcaaaaa gtggttggat ggtaagcaaa agggttctgt tgtttatgtt    840
gctttgggtt ccgaagcttt ggtttctcaa accgaagttg ttgaattggc tttgggtttg    900
gaattgtctg gtttgccatt tgtttgggct tacagaaaac ctaaaggtcc agctaagtct    960
gattctgttg aattgccaga tggttccgtt gaaagaacta gagatagagg tttggtttgg   1020
acttcttggg ctccacaatt gagaattttg tctcatgaat ccgtctgtgg tttcttgact   1080
cattgtggtt ctggttctat cgttgaaggt ttgatgtttg gtcacccatt gattatgttg   1140
ccaatctttg tgaccaaacc attgaacgct agattattgg aagataagca agtcggtatc   1200
gaaatcccaa gaaatgaaga agatggttgc ttgaccaaag aatctgttgc tagatctttg   1260
agatccgttg tcgttgaaaa agaaggtgaa atctacaagg ctaacgctag agaattgtcc   1320
aagatctaca cgataccaa  ggtcgaaaaa gaatacgttt cccaattcgt tgactacttg   1380
gaaaagaatg ctagagctgt tgccattgat catgaatctt ga                      1422
```

SEQ ID NO: 12
*Oryza sativa* sequence encoding EUGT11 (codon optimized)
```
atggatagtg ctactcctc  atcttatgct gctgccgctg gtatgcacgt tgtgatctgc     60
ccttggttgg cctttggtca cctgttacca tgtctggatt tagcccaaag actggcctca    120
agaggccata gagtatcatt tgtgtctact cctagaaata tctctcgttt accaccagtc    180
agacctgctc tagctcctct agttgcattc gttgctcttc cacttccaag agtagaagga    240
ttgccagacg cgctgaatc  tactaatgac gtaccacatg atagacctga catggtcgaa    300
ttgcatagaa gagccttga  tggattggca gctccatttg ctgagttcct gggcacagca    360
tgtgcagact gggttatagt cgatgtattt catcactggg ctgctgcagc cgcattggaa    420
cataaggtgc cttgtgctat gatgttgtta gggtcagcac acatgatcgc atccatagct    480
gatagaagat tggaaagagc tgaaacagaa tccccagccg cagcaggaca aggtaggcca    540
gctgccgccc caacctttga agtggctaga atgaaattga ttcgtactaa aggtagttca    600
gggatgagtc ttgctgaaag gttttctctg acattatcta gatcatcatt agttgtaggt    660
agatcctgcg tcgagttcga acctgaaaca gtacctttac tatctacttt gagaggcaaa    720
cctattactt tccttggtct aatgcctcca ttacatgaag gagggagagg agatggtgaa    780
gatgctactg ttaggtggtt agatgcccaa cctgctaagt ctgttgttta cgttgcattg    840
ggttctgagg taccactagg ggtggaaaag gtgcatgaat tagcattagg acttgagctg    900
gccggaacaa gattccttg  ggcttttgaga aaaccaaccg tgtttctga  cgccgacttg    960
ctaccagctg ggttcgaaga gaacaagag  ggccgtggtc tcgttgctac tagatgggtc   1020
ccacaaatga gtattctagc tcatgcagct gtagggggcct ttctaaccca ttgcggttgg   1080
aactcaacaa tagaaggact gatgtttggt catccactta ttatgttacc aatctttggc   1140
gatcagggac ctaacgcaag attgattgag gcaaagaacg caggtctgca ggttgcacgt   1200
aatgatggtg atggttcctt tgatagaaa  ggcgttgcag ctgccatcag agcagtcgcc   1260
gttgaggaag agtcatctaa agtttttccaa gctaaggcca aaaaattaca agagattgtg   1320
gctgacatgg cttgtcacga aagatacatc gatggtttca tccaacaatt gagaagtat   1380
aaagactaa                                                             1389
```

SEQ ID NO: 13
YBR180W
>sp|P38125|DTR1_YEAST Dityrosine transporter 1 OS = *Saccharomyces cerevisiae* (strain ATCC 204508 / S288c) GN = DTR1 PE = 1 SV = 1
MGSEPFQKKNLGLQINSQESGTTRSTFHSLEDLGDDVINESWDQVNQKRANIDHDVFHEH
PDSSPSLSAQKAKTKEEEVAVKSSNSQSRDPSPDTQAHIPYTYFSKDQRLIIFGIIIFIG
FLGPMSGNIYIPALPLLQREYDVSATTINATVSVFMAVFSVGPLFWGALADFGGRKFLYM
VSLSLMLIVNILLAAVPVNIAALFVLRIFQAFASSSVISLGAGTVTDVVPPKHRGKAIAY
FMMGPNMGPIIAPIVAGLILMKGNYWRWLFGFTSIMTGIALILVTALLPETLRCIVGNGD
PKWGDKKDERENNESPFFEGNKISHRRLFPDIGIRKPVNNDAFFQENFPKPPKAGLTLYW
KMIKCPPIIITSVSTALLFSSYYAFSVTFSYYLEHDYRFTMLEIGAAYVCPGVAMLLGSQ
SGGHLSDYLRSRWIKSHPKKKFPAEFRLLLNLIGILLTICGTIGYGWAIFFHYHFVVLLV
FSALTAFGMTWCSNTSMTYLTELFPKRAAGTVAVSSFFRNVGAAISSAIILQLCNAMGIG
WCFTGLGLCSSISLIGILYLLIFQRKYTAKEF TABLE 14-continued Sequences disclosed herein.

SEQ ID NO: 14
YAL067C
>sp|P39709|SEO1_YEAST Probable transporter SEO1 OS = *Saccharomyces cerevisiae* (strain ATCC 204508 / S288c) GN = SEO1 PE = 1 SV = 1
MYSIVKEIIVDPYKRLKWGFIPVKRQVEDLPDDLNSTEIVTISNSIQSHETAENFITTTS
EKDQLHFETSSYSEHKDNVNVTRSYEYRDEADRPWWRFFDEQEYRINEKERSHNKWYSWF
KQGTSFKEKKLLIKLDVLLAFYSCIAYWVKYLDTVNINNAYVSGMKEDLGFQGNDLVHTQ
VMYTVGNIIFQLPFLIYLNKLPLNYVLPSLDLDWSLLTVGAAYVNSVPHLKAIRFFIGAF
EAPSYLAYQYLFGSFYKHDEMVRRSAFYYLGQYIGILSAGGIQSAVYSSLNGVNGLEGWR
WNFIIDAIVSVVVGLIGFYSLPGDPYNCYSIFLTDDEIRLARKRLKENQTGKSDFETKVF
DIKLWKTIFSDWKIYILTLWNIFCWNDSNVSSGAYLLWLKSLKRYSIPKLNQLSMITPGL
GMVYLMLTGIIADKLHSRWFAIIFTQVFNIIGNSILAAWDVAEGAKWFAFMLQCFGWAMA
PVLYSWQNDICRRDAQTRAITLVTMNIMAQSSTAWISVLVWKTEEAPRYLKGFTFTACSA
FCLSIWTFVVLYFYKRDERNNAKKNGIVLYNSKHGVEKPTSKDVETLSVSDEK SEQ ID NO: 15
YBL089W
>sp|P38176|AVT5_YEAST Vacuolar amino acid transporter 5
OS = *Saccharomyces cerevisiae* (strain ATCC 204508 / S288c) GN = AVT5
PE = 3 SV = 2
MPSNVRSGVLTLLHTACGAGVLAMPFAFKPFGLMPGLITLTFCGICSLCGLLLQTRIAKY
VPKSENASFAKLTQLINPSISVVFDFAIAVKCFGVGVSYLIIVGDLVPQIVQSIFYRNDD
NMSGSQEHHMFLDRRLYITLIIVFVISPLCFKRSLNSLRYASMIAIVSVAYLSGLIIYHF
VNRHQLERGQVYFMVPHGDSQSHSPLTTLPIFVFAYTCHHNMFSVINEQVDKSFKVIRRI
PIFAIVLAYFLYIIGGTGYMTFGENIVGNILTLYPNSISTTIGRLAMLLLVMLAFPLQC
HPCRSSVKNIIIFIENFRKGKLYDNRASFIPLDNFNSEDPQEAPTQQNNEEPNLRSESLR
HINIITLCILLFSYLLAISITSLAKVLAIVGATGSTSISFILPGLFGYKLIGSEFTGTNE
RVPTSIKIFKYLSLSLFIWGIAVMVASLSAIVFLGTSSH SEQ ID NO: 16
YBL099W
>sp|P07251|ATPA_YEAST ATP synthase subunit alpha, mitochondrial
OS = *Saccharomyces cerevisiae* (strain ATCC 204508 / S288c) GN = ATP1
PE = 1 SV = 5
MLARTAAIRSLSRTLINSTKAARPAAAALASTRRLASTKAQPTEVSSILEERIKGVSDEA
NLNETGRVLAVGDGIARVFGLNNIQAEELVEFSSGVKGMALNLEPGQVGIVLFGSDRLVK
EGELVKRTGNIVDVPVGPGLLGRVVDALGNPIDGKGPIDAAGRSRAQVKAPGILPRRSVH
EPVQTGLKAVDALVPIGRGQRELIIGDRQTGKTAVALDTILNQKRWNNGSDESKKLYCVY
VAVGQKRSTVAQLVQTLEQHDAMKYSIIVAATASEAAPLQYLAPFTAASIGEWFRDNGKH
ALIVYDDLSKQAVAYRQLSLLLRRPPGREAYPGDVFYLHSRLLERAAKLSEKEGSGSLTA
LPVIETQGGDVSAYIPTNVISITDGQIFLEAELFYKGIRPAINVGLSVSRVGSAAQVKAL
KQVAGSLKLFLAQYREVAAFAQFGSDLDASTKQTLVRGERLTQLLKQNQYSPLATEEQVP
LIYAGVNGHLDGIELSRIGEFESSFLSYLKSNHNELLTEIREKGELSKELLASLKSATES
FVATF SEQ ID NO: 17
YBR241C
>sp|P38142|YB91_YEAST Probable metabolite transport protein YBR241C
OS = *Saccharomyces cerevisiae* (strain ATCC 204508 / S288c) GN = YBR241O
PE = 1 SV = 1
MAETERLMPNGGSRETKPLITGHLILGTIVACLGSIQYGYHIAELNAPQEFLSCSRFEAP
DENISYDDTWVGQHGLKQCIALTDSQYGAITSIFSIGGLFGSYYAGNWANRYGRKYVSMG
ASAMCMVSSLLLFFSNSYLQLLFGRFLVGMSCGTAIVITPLFINEIAPVEWRGAMGSMNQ
VSINLGILLTQTLALKYADSYNWRWLLFSGSVIAVANILAWLKVDESPRWLVSHGFVSEA
ETALFKLRPGTYQQAKQEIQDWQRSHGHNRDPESSEETHSGPTLWQYVTDPSYKKPRTVI
LAILSCQQFCGINSIIFYGVKVIGKILPDYSIQVNFAISILNVVVTLAASAIIDHVGRRP
LLLASTTVMTAMSLLISVGLTLSVSFLLVTATFVYIAAFAIGLGPIPFLIIGELSYPQDA
ATAQSFGTVCNWLATFIVGYLFPIGHGLMGGYVFAIFAAIAAMFATYVYKRVPETKGKTT
YSEVWAGY SEQ ID NO: 18
YBR294W
>sp|P38359|SUL1_YEAST Sulfate permease 1 OS = *Saccharomyces cerevisiae* (strain ATCC 204508 / S288c) GN = SUL1 PE = 1 SV = 2
MSRKSSTEYVHNQEDADIEVFESEYRTYRESEAAENRDGLHNGDEENWKVNSSKQKFGVT
KNELSDVLYDSIPAYEESTVTLKEYYDHSIKNNLTAKSAGSYLVSLFPIIKWFPHYNFTW
GYADLVAGITVGCVLVPQSMSYAQIASLSPEYGLYSSFIGAFIYSLFATSKDVCIGPVAV
MSLQTAKVIAEVLKKYPEDQTEVTAPIIATTLCLLCGIVATGLGILRLGFLVELISLNAV
AGFMTGSAFNIIWGQIPALMGYNSLVNTREATYKVVINTLKHLPNTKLDAVFGLIPLVIL
YVWKWWCGTFGITLADRYYRNQPKVANRLKSFYFYAQAMRNAVVIVVFTAISWSITRNKS
SKDRPISILGTVPSGLNEVGVMKIPDGLLSNMSSEIPASIIVLVLEHIAISKSFGRINDY
KVVPDQELIAIGVTNLIGTFFHSYPATGSFSRSALKAKCNVRTPFSGVFTGGCVLLALYC
LTDAFFFIPKATLSAVIIHAVSDLLTSYKTTWTFWKTNPLDCISFIVTVFITVFSSIENG
IYFAMCWSCAMLLLKQAFPAGKFLGRVEVAEVLNPTVQEDIDAVISSNELPNELNKQVKS
TVEVLPAPEYKFSVKWVPFDHGYSRELNINTTVRPPPPGVIVYRLGDSFTYVNCSRHYDI
IFDRIKEETRRGQLITLRKKSDRPWNDPGEWKMPDSLKSLFKFKRHSATTNSDLPISNGS
SNGETYEKPLLKVVCLDFSQVAQVDSTAVQSLVDLRKAVNRYADRQVEFHFAGIISPWIK

RSLLSVKFGTTNEEYSDDSIIAGHSSFHVAKVLKDDVDYTDEDSRISTSYSNYETLCAAT
GTNLPFFHIDIPDFSKWDV

SEQ ID NO: 19
YCL069W
>sp|P25594|VBA3_YEAST Vacuolar basic amino acid transporter 3
OS = Saccharomyces cerevisiae (strain ATCC 204508 / S288c) GN = VBA3
PE = 1 SV = 1
MNMLIVGRVVASVGGSGLQTLCFVIGCTMVGERSRPLVISILSCAFAVAAIVGPIIGGAF
TTHVTWRWCFYINLPIGGLAIIMFLLTYKAENKGILQQIKDAIGTISSFTFSKFRHQVNF
KRLMNGIIFKFDFFGFALCSAGLVLFLLGLTFGGNKYSWNSGQVIAYLVLGVLLFIFSLV
YDFFLFDKFNPEPDNISYRPLLLRRLVAKPAIIIINMVTFLLCTGYNGQMIYSVQFFQLI
FASSAWKAGLHLIPIVITNVIAAIASGVITKKLGLVKPLLIFGGVLGVIGAGLMTLMTNT
STKSTQIGVLLLPGFSLGFALQASLMSAQLQITKDRPEAAMDFIEVTAFNTFMKSLGTTL
GGVLSTTVFSASFHNKVSRAHLEPYEGKTVDDMILYRLQNYDGSHSTIGNILSDSIKNVF
WMDLGFYALGFLFCSFSSNKKLIIPKKDETPEDNLEDK SEQ ID NO: 20
YCR028C
>sp|P25621|FEN2_YEAST Pantothenate transporter FEN2 OS = Saccharomyces
cerevisiae (strain ATCC 204508 / S288c) GN = FEN2 PE = 1 SV = 1
MMKESKSITQHEVERESVSSKRAIKKRLLLFKIDLFVLSFVCLQYWINYVDRVGFTNAYI
SGMKEDLKMVGNDLTVSNTVFMIGYIVGMVPNNLMLLCVPPRIWLSFCTFAWGLLTLGMY
KVTSFKHICAIRFFQALFESCTFSGTHFVLGSWYKEDELPIRSAIFTGSGLVGSMFSGFM
QTSIFTHLNGRNGLAGWRWLFIIDFCITLPIAIYGFIFFPGLPDQTSAVSKFSMTRYIFN
EQELHYARRRLPARDESTRLDWSTIPRVLKRWHWWMFSLVWVLGGENLGFASNSTFALWL
QNQKYTLAQRNNYPSGIFAVGIVSTLCSAVYMSKIPRARHWHVSVFISLVMVIVAVLIRA
DPLNPKVVFSAQYLGGVAYAGQAVFFSWANIICHADLQERAIVLASMNMFSGAVNAWWSI
LFFASDMVPKFERGCYALLATAISSGIVSVVIRSLQIKENLSKKQVPYIDANDMPGEDDD
DDNQDNENDGDDESMEVELHNEEMAEISNPFR SEQ ID NO: 21
YCR075C
>sp|P17261|ERS1_YEAST Cystine transporter OS = Saccharomyces
cerevisiae (strain ATCC 204508 / S288c) GN = ERS1 PE = 1 SV = 1
MVSLDDILGIVYVTSWSISMYPPIITNWRHKSASAISMDFVMLNTAGYSYLVISIFLQLY
CWKMTGDESDLGRPKLTQFDFWYCLHGCLMNVVLLTQVVAGARIWRFPGKGHRKMNPWYL
RILLASLAIFSLLTVQFMYSNYWYDWHNSRTLAYCNNLFLLKISMSLIKYIPQVTHNSTR
KSMDCFPIQGVFLDVTGGIASLLQLIWQLSNDQGFSLDTFVTNFGKVGLSMVTLIFNFIF
IMQWFVYRSRGHDLASEYPL SEQ ID NO: 22
YDL128W
>sp|Q99385|VCX1_YEAST Vacuolar calcium ion transporter
OS = Saccharomyces cerevisiae (strain ATCC 204508 / S288c) GN = VCX1
PE = 1 SV = 1
MDATTPLLTVANSHPARNPKHTAWRAAVYDLQYILKASPLNFLLVFVPLGLIWGHFQLSH
TLTFLFNFLAIIPLAAILANATEELADKAGNTIGGLLNATFGNAVELIVSIIALKKGQVR
IVQASMLGSLLSNLLLVLGLCFIFGGYNRVQQTFNQTAAQTMSSLLAIACASLLIPAAFR
ATLPHGKEDHFIDGKILELSRGTSIVILIVYVLFLYPQLGSHHALFEQQEEETDEVMSTI
SRNPHHSLSVKSSLVILLGTTVIISFCADFLVGTIDNVVESTGLSKTFIGLIVIPIVGNA
AEHVTSVLVAMKDKMDLALGVAIGSSLQVALFVTPFMVLVGWMIDVPMTLNFSTFETATL
FIAVFLSNYLILDGESNWLEGVMSLAMYILIAMAFFYYPDEKTLDSIGNSL SEQ ID NO: 23
YDL185W
>sp|P17255|VATA_YEAST V-type proton ATPase catalytic subunit A
OS = Saccharomyces cerevisiae (strain ATCC 204508 / S288c) GN = VMA1
PE = 1 SV = 3
MAGAIENARKEIKRISLEDHAESEYGAIYSVSGPVVIAENMIGCAMYELVKVGHDNLVGE
VIRIDGDKATIQVYEETAGLTVGDPVLRTGKPLSVELGPGLMETIYDGIQRPLKAIKEES
QSIYIPRGIDTPALDRTIKWQFTPGKFQVGDHISGGDIYGSVFENSLISSHKILLPPRSR
GTITWIAPAGEYTLDEKILEVEFDGKKSDFTLYHTWPVRVPRPVTEKLSADYPLLTGQRV
LDALFPCVQGGTTCIPGAFGCGKTVISQSLSKYSNSDAIIYVGCFAKGTNVLMADGSIEC
IENIEVGNKVMGKDGRPREVIKLPRGRETMYSVVQKSQHRAHKSDSSREVPELLKFTCNA
THELVVRTPRSVRRLSRTIKGVEYFEVITFEMGQKKAPDGRIVELVKEVSKSYPISEGPE
RANELVESYRKASNKAYFEWTIEARDLSLLGSHVRKATYQTYAPILYENDHFFDYMQKSK
FHLTIEGPKVLAYLLGLWIGDGLSDRATFSVDSRDTSLMERVTEYAEKLNLCAEYKDRKE
PQVAKTVNLYSKVVRGNGIRNNLNTENPLWDAIVGLGFLKDGVKNIPSFLSTDNIGTRET
FLAGLIDSDGYVTDEHGIKATIKTIHTSVRDGLVSLARSLGLVVSVNAEPAKVDMNGTKH
KISYAIYMSGGDVLLNVLSKCAGSKKFRPAPAAAFARECRGFYFELQELKEDDYYGITLS
DDSDHQFLLANQVVVHNCGERGNEMAEVLMEEPELYTEMSGTKEPIMKRTTLVANTSNMP
VAAREASIYTGITLAEYFRDQGKNVSMIADSSSRWAEALREISGRLGEMPADQGFPAYLG
AKLASFYERAGKAVALGSPDRTGSVSIVAAVSPAGGDFSDPVTTATLGITQVFWGLDKKL
AQRKHFPSINTSVSYSKYTNVLNKFYDSNYPEFPVLRDRMKEILSNAEELEQVVQLVGKS
ALSDSDKITLDVATLIKEDFLQQNGYSTYDAFCPIWKTFDMMRAFISYHDEAQKAVANGA
NWSKLADSTGDVKHAVSSSKFFEPSRGEKEVHGEFEKLLSTMQERFAESTD TABLE 14-continued Sequences disclosed herein.

SEQ ID NO: 24
YDL194W
>sp|P10870|SNF3_YEAST High-affinity glucose transporter SNF3
OS = Saccharomyces cerevisiae (strain ATCC 204508 / S288c) GN = SNF3
PE = 1 SV = 3
MDPNSNSSSETLRQEKQGFLDKALQRVKGIALRRNNSNKDHTTDDTTGSIRTPTSLQRQN
SDRQSNMTSVFTDDISTIDDNSILFSEPPQKQSMMMSICVGVFVAVGGFLFGYDTGLINS
ITSMNYVKSHVAPNHDSFTAQQMSILVSFLSLGTFFGALTAPFISDSYGRKPTIIFSTIF
IFSIGNSLQVGAGGITLLIVGRVISGIGIGAISAVVPLYQAEATHKSLRGAIISTYQWAI
TWGLLVSSAVSQGTHARNDASSYRIPIGLQYVWSSFLAIGMFFLPESPRYYVLKDKLDEA
AKSLSFLRGVPVHDSGLLEELVEIKATYDYEASEGSSNFIDCFISSKSRPKQTLRMFTGI
ALQAFQQFSGINFIFYYGVNFFNKTGVSNSYLVSFITYAVNVVFNVPGLFFVEFFGRRKV
LVVGGVIMTIANFIVAIVGCSLKTVAAAKVMIAFICLFIAAPSATWGGVVWVISAELYPL
GVRSKCTAICAAANWLVNFICALITPYIVDTGSHTSSLGAKIFFIWGSLNAMGVIVVYLT
VYETKGLTLEEIDELYIKSSTGVVSPKFNKDIRERALKFQYPDLQRLEDGKNTFVAKRNN
FDDETPRNDFRNTISGEIDHSPNQKEVHSIPERVDIPTSTEILESPNKSSGMTVPVSPSL
QDVPIPQTTEPAEIRTKYVDLGNGLGLNTYNRGPPSLSSDSSEDYTEDEIGGPSSQGDQS
NRSTMNDINDYMARLIHSTSTASNTTDKFSGNQSTLRYHTASSHSDTTEEDSNLMDLGNG
LALNAYNRGPPSILMNSSDEEANGGETSDNLNTAQDLAGMKERMAQFAQSYIDKRGGLEP
ETQSNILSTSLSVMADTNEHNNEILHSSEENATNQPVNENNDLK SEQ ID NO: 25
YDL210W
>sp1P32837|UGA4_YEAST GABA-specific permease OS = Saccharomyces
cerevisiae (strain ATCC 204508 / S288c) GN = UGA4 PE = 1 SV = 1
MSMSSKNENKISVEQRISTDIGQAYQLQGLGSNLRSIRSKTGAGEVNYIDAAKSVNDNQL
LAEIGYKQELKRQFSTLQVFGIAFSIMGLLPSIASVMGGGLGGPATLVWGWFVAAFFIL
LVGITMAEHASSIPTAGGLYYWTYYYAPEGYKEIISFIIGCSNSLALAAGVCSIDYGLAE
EIAAAVTLTKDGNFEVTSGKLYGIFAGAVVVMCICTCVASGAIARLQTLSIFANLFIIVL
LFIALPIGTKHRMGGFNDGDFIFGKYENLSDWNNGWQFCLAGEMPAVWTIGSFDSCVHQS
EEAKDAKKSVPIGIISSIAVCWILGWLIIICLMACINPDIDSVLDSKYGFALAQIIYDSL
GKKWAIAFMSLIAFCQFLMGASITAVSRQVWAFSRDNGLPLSKYIKRVDSKYSVPFFAI
LAACVGSLILGLLCLIDDAATDALFSLAVAGNNLAWSTPTVFRLTSGRDLFRPGPFYLGK
IWSPIVAWTGVAFQLFIIILVMFPSQQHGITKSTMNYACVIGPGIWILAGIYYKVYKKKY
YHGPATNLSDDDYTEAVGADVIDTIMSKQEP SEQ ID NO: 26
YDR061W
>sp|Q12298|YD061_YEAST Uncharacterized ABC transporter ATP-binding
protein YDR061W OS = Saccharomyces cerevisiae (strain ATCC 204508 /
S288c) GN = YDR061W PE = 1 SV = 1
MSTNKFVVRITNALFKSSLASNSPPVYPKRIRHFEILPNEKWVIWGPGKGKFLDVLNNKY
ICEPPLSLRFGFLKESSNILPRIEQVAFKGVMPTAHLSARYEYFKDDYDQTCKQFIFDKA
SGSNAVSYKVETNNRQINMELYNALVENLNLSSLQDRWVMGLSNGQMRRARLARSILKEP
DLLLIDDPFLGLDPAAIATISQFLAKYDSIEVSGGCPIVIGLRYQDTIPAWCTHICCVDE
KNGILFEGPIEKLQSKMDETRSRALKELEQLKKASNSKEDISINDLICIHPMYGKKEHEI
IKMPHLIELDGLSVSYKGEAVLENLHWKVQPGSKWHIRGDNGSGKSTLLSLLTAEHPQSW
NSRVIDNGVPRRTGKTNYFDLNSKIGMSSPELHAIFLKNAGGRLNIRESVATGYHEASSN
NYLPIWKRLDKNSQEIVNMYLKYFGLDKDADSVLFEQLSVSDQKLVLFVRSLIKMPQILI
LDEAFSGMEVEPMMRCHEFLEEWPGTVLVVAHVAEETPKCAHYLRLISPGEYEIGDMEN SEQ ID NO: 27
YDR093W
>sp|Q12675|ATC4_YEAST Phospholipid-transporting ATPase DNF2
OS = Saccharomyces cerevisiae (strain ATCC 204508 / S288c) GN = DNF2
PE = 1 SV = 1
MSSPSKPTSPFVDDIEHESGSASNGLSSMSPFDDSFQFEKPSSAHGNIEVAKTGGSVLKR
QSKPMKDISTPDLSKVTFDGIDDYSNDNDINDDDELNGKKTEIHEHENEVDDDLHSFQAT
PMPNTGGFEDVELDNNEGSNNDSQADHKLKRVRFGTRRNKSGRIDINRSKTLKWAKKNFH
NAIDEFSTKEDSLENSALQNRSDELRTVYYNLPLPEDMLDEDGLPLAVYPRNKIRTTKYT
PLTFFPKNILFQFHNFANIYFLILLILGAFQIFGVTNPGFASVPLIVIVIITAIKDGIED
SRRTVLDLEVNNTRTHILSGVKNENVAVDNVSLWRRFKKANTRALIKIFEYFSENLTAAG
REKKLQKKREELRRKRNSRSFGPRGSLDSIGSYRMSADFGRPSLDYENLNQTMSQANRYN
DGENLVDRTLQPNPECRFAKDYWKNVKVGDIVRVHNNDEIPADMILLSTSDVDGACYVET
KNLDGETNLKVRQSLKCSKIIKSSRDITRTKFWVESEGPHANLYSYQGNFKWQDTQNGNI
RNEPVNINNLLLRGCTLRNTKWAMGMVIFTGDDTKIMINAGVTPTKKSRISRELNFSVIL
NFVLLFILCFTAGIVNGVYYKQKPRSRDYFEFGTIGGSASTNGFVSFWVAVILYQSLVPI
SLYISVEIIKTAQAIFIYTDVLLYNAKLDYPCTPKSWNISDDLGQIEYIFSDKTGTLTQN
VMEFKKCTINGVSYGRAYTEALAGLRKRQGVDVESEGRREKEEIAKDRETMIDELRSMSD
NTQFCPEDLTFVSKEIVEDLKGSSGDHQQKCCEHFLLALALCHSVLVEPNKDDPKKLDIK
AQSPDESALVSTARQLGYSFVGSSKSGLIVEIQGVQKEFQVLNVLEFNSSRKRMSCIIKI
PGSTPKDEPKALLICKGADSVIYSRLDRTQNDATLLEKTALHLEEYATEGLRTLCLAQRE
LTWSEYERWVKTYDVAAASVTNREEELDKVTDVIERELILLGGTAIEDRLQDGVPDSIAL
LAEAGIKLWVLTGDKVETAINIGFSCNVLNNDMELLVVKASGEDVEEFGSDPIQVVNNLV
TKYLREKFGMSGSEEELKEAKREHGLPQGNFAVIIDGDALKVALNGEEMRRKFLLLCKNC
KAVLCCRVSPAQKAAVVKLVKKTLDVMTLAIGDGSNDVAMIQSADVGVGIAGEEGRQAVM
CSDYAIGQFRYVTRLVLVHGKWCYKRLAEMIPQFFYKNVIFTLSLFWYGIYNNFDGSYLF
EYTYLTFYNLAFTSVPVILLAVLDQDVSDTVSMLVPQLYRVGILRKEWNQTKFLWYMLDG TABLE 14-continued Sequences disclosed herein.

VYQSVICFFFPYLAYHKNMVVTENGLGLDHRYFVGVFVTAIAVTSCNFYVFMEQYRWDWF
CGLFICLSLAVFYGWTGIWTSSSSSNEFYKGAARVFAQPAYWAVLFVGVLFCLLPRFTID
CIRKIFYPKDIEIVREMWLRGDFDLYPQGYDPTDPSRPRINEIRPLTDFKEPISLDTHFD
GVSHSQETIVTEEIPMSILNGEQGSRKGYRVSTTLERRDQLSPVTTNNLPRRSMASARG
NKLRTSLDRTREEMLANHQLDTRYSVERARASLDLPGINHAETLLSQRSRDR

SEQ ID NO: 28
YDR338C
>sp|Q05497|YD338_YEAST Uncharacterized transporter YDR338C
OS = Saccharomyces cerevisiae (strain ATCC 204508 / S288c) GN = YDR3380
PE = 1 SV = 1
MAGILSKTLSEVHPSLRTNGMGIGNTHRRISLGFLPPNKKNPLVRKFRARTRNIDQRSFR
SLTDDFGSNVHEPNPYLGNIDEEPDLYYHDEEDGELSRTISLPSRVSETPELSPQDVDWI
LHEHERRYSSVCNSDNEEASQSNTPDRIQEYSGRELEYDEFMNRLQAQKQKLTRSAVTDA
KGTSHHRRPSFVSVTSRGSVPTIYQEIDENDSEALAELAHSHVTFKSEARVLASYSFPLI
FTFLLEQIFPMVCSLTVGHLGKNELAAVSLASMTSNITLAIFEGIATSLDTLCPQAYGSG
RFYSVGVHLQRCIAFSLVIYIPFAVMWWYSEPLLSYIIPEKELINLTSRFLRVLILGAPA
YIFFENLKRFLQAQGIFDAGIYVLTICAPLNVLVSYTLVWNKYIGVGFIGAAIAVVLNFW
LMFFLLLFYALYIDGRKCWGGFSRKAFTHWNDLGHLAFSGIIMLEAEELSYELLTLFSAY
YGVSYLAAQSAVSTMAALLYMIPFAIGISTSTRIANFIGAKRTDFAHISSQVGLSFSFIA
GFINCCILVFGRNLIANIYSKDPEVIKLIAQVLPLVGIVQNFDSLNAVAGSCLRGQGMQS
LGSIVNLMAYYLFGIPLALILSWFFDMKLYGLWIGIGSAMLLIGLVEAYYVLFPDWDKIM
TYAEILKETEDDEVDSDEYLTDSDDPDENTALLGA SEQ ID NO: 29
YDR406W
>sp|Q04182|PDR15_YEAST ATP-dependent permease PDR15 OS = Saccharomyces
cerevisiae (strain ATCC 204508 / S288c) GN = PDR15 PE = 1 SV = 1
MSSDIRDVEERNSRSSSSSSSSNSAAQSIGQHPYRGFDSEAAERVHELARTLTSQSLLYT
ANSNNSSSSNHNAHNADSRSVFSTDMEGVNPVFTNPDTPGYNPKLDPNSDQFSSTAWVQN
MANICTSDPDFYKPYSLGCVWKNLSASGDSADVSYQSTFANIVPKLLTKGLRLLKPSKEE
DTFQILKPMDGCLNPGELLVVLGRPGSGCTTLLKSISSNSHGFKIAKDSIVSYNGLSSSD
IRKHYRGEVVYNAESDIHLPHLTVYQTLFTVARMKTPQNRIKGVDREAYANHVTEVAMAT
YGLSHTRDTKVGNDLVRGVSGGERKRVSIAEVAICGARFQCWDNATRGLDSATALEFIRA
LKTQADIGKTAATVAIYQCSQDAYDLFDKVCVLDDGYQLYFGPAKDAKKYFQDMGYYCPP
RQTTADPFLTSITSPTERIISKEFIEKGTRVPQTPKDMAEYWLQSESYKNLIKDIDSTLEK
NTDEARNIIRDAHHAKQAKRAPPSSPYVVNYGMQVKYLLIRNFWRMKQSASVTLWQVIGN
SVMAFILGSMFYKVMKKNDTSTFYFRGAAMFFAILFNAFSCLLEIFSLYETRPITEKHRT
YSLYHPSADAFASVLSEMPPKLITAVCFNIIFYFLVDFRRNGGVFFFYFLINVIATFTLS
HLFRCVGSLTKTLQEAMVPASMLLLAISMYTGFAIPKTKILGVKCGERIGRKPLIMGSVO
MINEFHDRRFPCAQYIPAGPAYQNITGTQRVCSAVGAYPGNDYVLGDDFLKESYDYEHKH
KWRGFGIGMAYVVFFFFVYLILCEYNEGAKQKGEMVVFLRSKIKQLLKKEGKLQEKHRPGD
IENNAGSSPDSATTEKKILDDSSEGSDSSSDNAGLGLSKSEAIFHWRDLCYDVPIKGGQR
RILNNVDGWVKPGTLTALMGASGAGKTTLLDCLAERVTMGVITGNIFVDGRLRDESFPRS
IGYCQQQDLHLKTATVRESLRFSAYLRQPSSVSIEEKNRYVEEVIKILEMQQYSDAVVGV
AGEGLNVEQRKRLTIGVELAARPKLLVFLDEPTSGLDSQTAWDTCQLMRKLATHGQAILC
TIHQPSAILMQQFDRLLFLQKGGQTVYFGDLGEGCKTMIDYFESKGAHKCPPDANPAEWM
LEVVGAAPGSHATQDYNEVWRNSDEYKAVQEELDWMEKNLPGRSKEPTAEEHKPFAASLY
YQFKMVTIRLFQQYWRSPDYLWSKFILTIFNQVFIGFTFFKADRSLQGLQNQMLSIFMYT
VIFNPILQQYLPSFVQQRDLYEARERPSRTFSWLAFFLSQIIVEIPWNILAGTIAYCIYY
YAVGFYANASAAGQLHERGALFWLFSIAFYVYIGSMGLLMISFNEVAETAAHMGTLLFTM
ALSFCGVMATPKVMPRFWIFMYRVSPLTYMIDALLALGVANVDVKCSNYEMVKFTPPSGT
TCGDYMASYIKLAGTGYLSDPSATDICSFCAVSTTNAFLATFSSHYYRRWRNYGIFICYI
AFDYIAATFLYWLSRVPKKNGKISEKPKK SEQ ID NO: 30
YDR536W
>sp|P39932|STL1_YEAST Sugar transporter STL1 OS = Saccharomyces
cerevisiae (strain ATCC 204508 / S288c) GN = STL1 PE = 1 SV = 2
MKDLKLSNFKGKFISRTSHWGLTGKKLRYFITIASMTGFSLFGYDQGLMASLITGKQFNY
EFPATKENGDHDRHATVVQGATTSCYELGCFAGSLFVMFCGERIGRKPLILMGSVITIIG
AVISTCAFRGYWALGQFIIGRVVTGVGTGLNTSTIPVWQSEMSKAENRGLLVNLEGSTIA
FGTMIAYWIDFGLSYTNSSVQWRFPVSMQIVFALLLAFMIKLPESPRWLISQSRTEEEAR
YLVGTLDDADPNDEEVITEVAMLHDAVNRTKHEKHSLSSLFSRGRSQNLQRALIAASTQF
FQQFTGCNAAIYYSTVLFNKTIKLDYRLSMIIGGVFATIYALSTIGSFFLIEKLGRRKLF
LLGATGQAVSFTITFACLVKENKENARGAAVGLFLFITFFGLSLLSLPWIYPPEIASMKV
RASTNAFSTCTNWLCNFPAVVMFTPIFIGQSGWGCYLFFAVMNYLYIPVIFFFYPETAGRS
LEEEIDIIFAKAYEDGTQPWRVANHLPKLSLQEVEDHANALGSYDDEMEKEDFGEDRVEDT
YNQIGNDNSSSSSNIKNEDTVNDKANFEG SEQ ID NO: 31
YEL031W
>sp|P39986|ATC6_YEAST Manganese-transporting ATPase I
OS = Saccharomyces cerevisiae (strain ATCC 204508 / S288c) GN = SPF1
PE = 1 SV = 1
MTKKSFVSSPIVRDSTLLVPKSLIAKPYVLPFFPLYATFAQLYFQQYDRYIKGPEWTFVY
LGTLVSLNILVLMLMPAWNVIKAKFNYSTTKNVNEATHILIYTTPNNGSDGIVEIQRVTE
AGSLQTFFQFQKKRFLWHENEQVFSSPKFLVDESPKIGDFQKCKGHSGDLTHLKRLYGEN TABLE 14-continued Sequences disclosed herein.

SFDIPIPTFMELFKEHAVAPLFVFQVFCVALWLLDEFWYYSLFNLFMIISMEAAAVFQRL
TALKEFRTMGIKPYTINVFRNKKWVALQTNELLPMDLVSITRTAEESAIPCDLILLDGSA
IVNEAMLSGESTPLLKESIKLRPSEDNLQLDGVDKIAVLUGGTKALQVTPPEHKSDIPPP
PDGGALAIVTKTGFETSQGSLVRVMIYSAERVSVDNKEALMFILFLLIFAVIASWYVWVE
GTKMGRIQSKLILDCILIITSVVPPELPMELTMAVNSSLAALAKFYVYCTEPFRIPFAGR
IDVCCFDKTGTLTGEDLVFEGLAGISADSENIRHLYSAAEAPESTILVIGAAHALVKLED
GDIVGDPMEKATLKAVGWAVERKNSNYREGTGKLDIIRRFQFSSALKRSASIASHNDALF
AAVKGAPETIRERLSDIPKNYDEIYKSFTRSGSRVLALASKSLPKMSQSKIDDLNRDDVE
SELTFNGFLIFHCPLKDDAIETIKMLNESSHRSIMITGDNPLTAVHVAKEVGIVFGETLI
LDRAGKSDDNQLLFRDVEETVSIPFDPSKDTFDHSKLFDRYDIAVTGYALNALEGHSQLR
DLLRHTWVYARVSPSQKEFLLNTLKDMGYQTLMCGDGTNDVGALKQAHVGIALLNGTEEG
LKKLGEQRRLEGMKMMYIKQTEFMARWNQPQPPVPEPIAHLFPPGPKNPHYLKALESKGT
VITPEIRKAVEEANSKPVEVIKPNGLSEKKPADLASLLLNSAGDAQGDEAPALKLGDASC
AAPFTSKLANVSAVTNIIRQGRCALVNTIQMYKILALNCLISAYSLSIIYMAGVKFGDGQ
ATVSGLLLSVCFLSISRGKPLEKLSKQRPQSGIFNVYIMGSILSQFAVHIATLVYITTEI
YKLEPREPQVDLEKEFAPSLLNTGIFIIQLVQQVSTFAVNYQGEPFRENIRSNKGMYYGL
LGVTGLALASATEFLPELNEAMKFVPMTDDFKIKLTLTLLLDFFGSWGVEHFFKFFFMDD
KPSDISVQQVKIASK

SEQ ID NO: 32
YER166W
>sp|P32660|ATC5_YEAST Phospholipid-transporting ATPase DNF1
OS = *Saccharomyces cerevisiae* (strain ATCC 204508 / S288c) GN = DNF1
PE = 1 SV = 2
MSGTFHGDGHAPMSPFEDTFQFEDNSSNEDTHIAPTHFDDGATSNKYSRPQVSFNDETPK
NKREDAEEFTFNDDTEYDNHSFQPTPKLNNGSGTFDDVELDNDSGEPHTNYDGMKRFRMG
TKRNKKGNPIMGRSKTLKWARKNIPNPFEDFTKDDIDPGAINRAQELRTVYYNMPLPKDM
IDEEGNPIMQYPRNKIRTTKYTPLIFLPKNILFQPHNFANVYFLVLIILGAFQIFGVTNP
GLSAVPLVVIVIITAIKDAIEDSRRTVLDLEVNNTKTHILEGVENENVSTDNISLWRRFK
KANSRLLFKFIQYCKEHLTEEGKKKRMQRKRHELRVQKTVGTSGPRSSLDSIDSYRVSAD
YGRPSLDYDNLEQGAGEANIVDRSLPPRTDCKFAKNYWKGVKVGIDVIRIHNNDEIPADII
LLSTSDTDGACYVETKNLDGETNLKVRQSLKCTNTIRTSKDIARTKFWIESEGPHSNLYT
YQGNMKWRNLADGEIRNEPITINNVLLRGCTLRNTKWAMGVVMFTGGDTKIMLNSGITPT
KKSRISRELNFSVVINFVLLFILCFVSGIANGVYYDKKGRSRFSYEFGTIAGSAATNGFV
SFWVAVILYQSLVPISLYISVEIIKTAQAAFIYGDVLLYNAKLDYPCTPKSWNISDDLGQ
VEYIFSDKTGTLTQNVMEFKKCTINGVSYGRAYTEALAGLRKRQGIDVETEGRREKAEIA
KDRDTMIDELRALSGNSQFYPEEVTFVSKEFVRDLKGASGEVQQRCCEHFMLALALCHSV
LVEANPDNPKKLDLKAQSPDEAALVATARDVGFSFVGKTKKGLIIEMQGIQKEFEILNIL
EFNSSRKRMSCIVKIPGLNPGDEPRALLICKGADSIIYSRLSRQSGSNSEAILEKTALHL
EQYATEGLRTLCIAQRELSWSEYEKWNEKYDIAAASLANREDELEVVADSIERELILLGG
TAIEDRLQDGVPDCIELLAEAGIKLWVLTGDKVETAINIGFSCNLLNNEMELLVIKTTGD
DVKEFGSEPSEIVDALLSKYLKEYFNLTGSEEEIFEAKKDHEFPKGNYAIVIDGDALKLA
LYGEDIRRKFLLLCKNCRAVLCCRVSPSQKAAVVKLVKDSLDVMTLAIGDGSNDVAMIQS
ADVGIGIAGEEGRQAVMCSDYAIGQFRYLARLVLVHGRWSYKRLAEMIPEFFYKNMIFAL
ALFWYGIYNDFDGSYLYEYTYMMFYNLAFTSLPVIFLGILDQDVNDTISLVVPQLYRVGI
LRKEWNQRKFLWYMLDGLYQSIICFFFPLVVMKNMIVISNGLGLDHRYFVGVYTTIAV
ISCNTYVLLHQYRWDWFSGLFIALSCLVVFAWTGIWSSAIASREFFKAAARIYGAPSFWA
VFFVAVLFCLLPRFTYDSFQKFFYPTDVEIVREMWQMGHFDHYPPGYDPIDPNRPKVTKA
GQHGEKIIEGIALSDNLGGSNYSRDSVVTEEIPMTFMHGEDGSPSGYQKQETWMTSPKET
QDLLQSPQFQQAQTFGRGPSINVRSSLDRTREQMIATNQLDNRYSVERARTSLDLPGVIN
AASLIGTQQNN SEQ ID NO: 33
YFL011W
>sp|P43581|HXT10_YEAST Hexose transporter HXT10 OS = *Saccharomyces
cerevisiae* (strain ATCC 204508 / S288c) GN = HXT10 PE = 1 SV = 1
MVSSSVSILGTSAKASTSLSRKDEIKLTPETREASLDIPYKPIIAYWTVMGLCLMIAFGG
FIFGWDTGTISGFINQTDFKRRFGELQRDGSFQLSDVRTGLIVGIFNIGCALGGLTLGRL
GDIYGRKIGLMCVILVYVVGIVIQIASSDKWYQYFIGRIVSGMGVGGVAVLSPTLISEIS
PKHLRGTCVSFYQLMITLGIFLGYCTNYGTKKYSNSIQWRVPLGLCFAWAIFMVIGMVMV
PESPRYLVEKGKYEEARRSLAKSNKVTVTDPGVVFEFDTIVANMELERAVGNASWHELFS
NKGAILPRVIMGIVIQSLQQLTGCNYFFYYGTTIFNAVGMQDSFETSIVLGAVNFASTFV
ALYIVDKFGRRKCLLWGSASMAICFVIFATVGVTRLWPQGKDQPSSQSAGNVMIVFTCFF
IFSFAITWAPIAYVIVAETYPLRVKNRAMAIAVGANWMWGFLIGFFTPFITRSIGFSYGY
VPMGCLIFSYFYVFFFVCETKGLTLEEVNEMYEERIKPWKSGGWIPSSRRTPQPTSSTPL
VIVDSK SEQ ID NO: 34
YGL006W
>sp|P38929|ATC2_YEAST Calcium-transporting ATPase 2 OS = *Saccharomyces
cerevisiae* (strain ATCC 204508 / S288c) GN = PMC1 PE = 1 SV = 1
MSRQDENSALLANNENNKPSYTGNENGVYDNFKLSKSQLSDLHNPKSIRSFVRLFGYESN
SLFKYLKTDKNAGISLPEISNYRKTNRYKNYGDNSLPERIPKSFLQLVWAAFNDKTMQLL
TVAAVVSFVLGLYELWMQPPQYDPEGNKIKQVDWIEGVAIMIAVFVVVLVSAANDYQKEL
QFAKLNKKKENRKIIVIRNDQEILISIHHVLGDVISLQTGDVVPADCVMISGKCEADES
SITGESNTIQKFPVDNSLRDFKKFNSIDSHNHSKPLDIGDVNEDGNKIADCMLISGSRIL TABLE 14-continued Sequences disclosed herein.

SGLGRGVITSVGINSVYGQTMTSLNAEPESTPLQLHLSQLADNISVYGCVSAIILFLVLF
TRYLFYIIPEDGRFHDLDPAQKGSKFMNIFITSITVIVVAVPEGLPLAVTLALAFATTRM
TKDGNLVRVLRSCETMGSATAVCSDKTGTLTENVMTVVRGFPGNSKFDDSKSLPVSEQRK
LNSKKVFEENCSSSLRNDLLANIVLNSTAFENRDYKKNDKNTNGSKNMSKNLSFLDKCKS
RLSFFKKGNREDDEDQLFKNVNKGRQEPFIGSKTETALLSLARLSLGLQPGELQYLRDQP
MEKFNIEKVVQTIPFESSRKWAGLVVKYKEGKNKKPFYRFFIKGAAEIVSKNCSYKRNSD
DTLEEINEDNKKETDDEIKNLASDALRAISVAHKDFCECDSWPPEQLRDKDSPNIAALDL
LFNSQKGLILDGLLGIQDPLRAGVRESVQQCQRAGVTVRMVTGDNILTAKAIARNCAILS
TDISSEAYSAMEGTEFRKLTKNERIRILPNLRVLARSSPEDKRLLVETLKGMGDVVAVTG
DGTNDAPALKLADVGFSMGISGTEVAREASDIILMTDDFSAIVNAIKWGRCVSVSIKKFI
QFQLIVNITAVILTFVSSVASSDETSVLTAVQLLWINLIMDTLAALALATDKPDPNIMDR
KPRGRSTSLISVSTWKMILSQATLQLIVTFILHFYGPELFFKKHEDEITSHQQQQLNAMT
FNTFVWLQFFTMLVSRKLDEGDGISNWRGRISAANLNFFQDLGRNYYFLTIMAIIGSCQV
LIMFFGGAPFSIARQTKSMWITAVLCGMLSLIMGVLVRICPDEVAVKVFPAAFVQRFKYV
FGLEFLRKNHTGKHDDEEALLEESDSPESTAFY

SEQ ID NO: 35
YGL013C
>sp|P12383|PDR1_YEAST Transcription factor PDR1 OS = Saccharomyces
cerevisiae (strain ATCC 204508 / S288c) GN = PDR1 PE = 1 SV = 2
MRGLTPKNGVHIETGPDTESSADSSNFSTGFSGKIRKPRSKVSKACDNCRKRKIKCNGKF
PCASCEIYSCECTFSTRQGGARIKNLHKTSLEGTTVQVKEETDSSSTSFSNPQRCTDGPC
AVEQPTKFFENFKLGGRSSGDNSGSDGKNDDDVNRNGFYEDDSESQATLTSLQTTLKNLK
EMAHLGTHVTSAIESIELQISDLLKRWEPKVRTKELATTKFYPNKSIETQLMKNKYCDVV
HLTRYAAWSNNKKDQDTSSQPLIDEIFGLYSPFQFLSLQGIGKCFQNYRSKSKCEIFPRT
AKETIYIMLRFFDVCFHHINQGCVSIANPLENYLQKMNLLPSTPSSISSAGSPNTAHTKS
HVALVINHLPQPFVRNITGISNSELLSEMNNDISMFGILLKMLDMHKNSYQNFLMEITSN
PSVAKNTQSIDVLQEFIHYCQAGEALIALCYSYYNSTLYNYVDFTCDITHLEQLLYFLDL
LFWLSEIYGFEKVLNVAVHFVSRVGLSRWEFYVGLDENFAERRRNLWWKAFYFEKTLASK
LGYPSNIDDSKINCLLPKNFRDVGFLDNRDFIENVHLVRRSEAFDNMCISDLKYYGELAV
LQIVSHFSSSVLFNEKFTSIRNTSKPSVVREKLLFEVLEIFNETEMKYDAIKEQTGKLFD
IAFSKDSTELKVSREDKIMASKFVLFYEHHFCRMVNESDNIVARLCVHRRPSILIENLKI
YLHKIYKSWTDMNKILLDFDNDYSVYRSFAHYSISCIILVSQAFSVAEFIKVNDVVNMIR
VFKRFLDIKIFSENETNEHVFNSQSFKDYTRAFSFLTIVTRIMLLAYGESSSTNLDVISK
YIDENAPDLKGIIELVLDTNSCAYRFLLEPVQKSGFHLTVSQMLKNRKFQEPLMSNEDNK
QMKHNSGKNLNPDLPSLKTGTSCLLNGIESPQLPFNGRSAPSPVRNNSLPEFAQLPSFRS
LSVSDMINPDYAQPTNGQNNTQVQSNKPINAQQQIPTSVQVPFMNTNEINNNNNNNNNNK
NNINNINNNNSNNFSATSFNLGTLDEFVNNGDLEDLYSILWSDVYPDS SEQ ID NO: 36
YGL255W
>sp|P32804|ZRT1_YEAST Zinc-regulated transporter 1 OS = Saccharomyces
cerevisiae (strain ATCC 204508 / S288c) GN = ZRT1 PE = 1 SV = 1
MSNVTTPWWKQWDPSEVTLADKTPDDVWKTCVLQGVYFGGNEYNGNLGARISSVFVILFV
STFFTMFPLISTKVKRLRIPLYVYLFAKYFGSGVIVATAFIHLMDPAYGAIGGTTCVGQT
GNWGLYSWCPAIMLTSLTFTFLTDLFSSVWVERKYGLSHDHTHDEIKDTVVRNTAAVSSE
NDNENGTANGSHDTKNGVEYYEDSDATSMDVVQSFQAQFYAFLILEFGVIFHSVMIGLNL
GSVGDEFSSLYPVLVFHQSFEGLGIGARLSAIEFPRSKRWWPWALCVAYGLTTPICVAIG
LGVRTRYVSGSYTALVISGVLDAISAGILLYTGLVELLARDFIFNPQRTKDLRELSFNVI
CTLFGAGIMALIGKWA SEQ ID NO: 37
YGR125W
>sp|P53273|YG35_YEAST Uncharacterized vacuolar membrane protein
YGR125W OS = Saccharomyces cerevisiae (strain ATCC 204508 / S288c)
GN = YGR125W PE = 1 SV = 1
MGRTIRRRSNSSLSEAISVSLGINQDSSVNKMHRASVSAMSPPLCRSYMSGFFTGGNSP
MINNLSDSKLPISNKQHPKVIHGSENLHRQTAQLSNEFCSSSVEENSPTIKDYMDIIGNG
DRKDDQSMRTIEENIDEEYSDEYSRLLLSPASSNVDDDRNRGLQNSSLPELEDGYAGGYQ
SLRPSHNLRFRPRNLWHMCTSFPSKFAHYLPAAVLGLLLNILDALSYGMIIFPITEPVFS
HLGPTGISMFYISTIISQAVYSGGWSSFPSGIGSEMIEITPFYHTMALAIKEALAGNDDE
IIITTTIFCYVISSMLTGVVFYALGKLRLGKIVGFFPRHILIGCIGGVGYFLIITGIEVTT
RVAKFEYSWPFFSGLFTDYDTLAKWLLPVLLTVVLIGTQRYFKNSLVLPSFYILTLVLFH
FIVAIIPTLSLDALRQAGWIFPIANSDSKWYDHYRLFNVHKVHWSLVLQQIPTMMALTFF
GILHVPINVPALAMSLQMDKYDVDRELIAHGYSNFFSGLLGSVQNYLVYTNSVLFIRAGA
DSPFAGFLLIALTICIMIIGPVIISFIPICIVGSLIFLLGYELLVEALVDTWNKLNRFEY
LTVVIIVFTMGIFDFVLGIIVGILIACFSFLVDSTKLQTINGEYNGNVARSTVYRDYVQT
KFLDGIGEQIYVLKLQNLLFFGTIISIEEKIERLLQISNKDATKRRIKYLILDFKNINAD
NIDYSAAEGFNRIKRFTETKRIKLIISSIKERDRIYNAFNNVGLLNDVELFADLNSALEW
CENEFLFQYKQLRKKAKERLEEGKQNNVVSAVIAATKNKKIDTIGNGLNRGSNGDTARNL
MSLPTNTPRNYQILSVAQNVFVNDEQAVKNFKKEYKDDEPVLPILLFALKQYRPDIISEV
QKVREKEIKFWAQLCPYFTRRRLASQSHLLHADNIFFLVETGMLKATYELPQGTLYEIFS
NGTCFGKIIAPGNAMPREQKLTIETETDSVLWVIDSSSLNKLKEDNLALYVEVALMVMCI
KDTRFKELLGYTLVSA TABLE 14-continued Sequences disclosed herein.

SEQ ID NO: 38
YGR181W
>sp|P53299|TIM13_YEAST Mitochondrial import inner membrane
translocase subunit TIM13 OS = Saccharomyces cerevisiae (strain ATCC
204508 / S288c) GN = TIM13 PE = 1 SV = 1
MGLSSIFGGGAPSQQKEAATTAKTTPNPIAKELKNQIAQELAVANATELVNKISENCFEK
CLTSPYATRNDACIDQCLAKYMRSWNVISKAYISRIQNASASGEI SEQ ID NO: 39
YGR217W
>sp|P50077|CCH1_YEAST Calcium-channel protein CCH1 OS = Saccharomyces
cerevisiae (strain ATCC 204508 / S288c) GN = CCH1 PE = 1 SV = 1
MQGRKRTLTEPFEPNTNPFGDNAAVMTENVEDNSETDGNRLESKPQALVPPALNIVPPES
SIHSTEEKKGDEYNGNDKDSSLISNIFRTRVGRSSHENLSRPKLSLKTASFGAAESSRRN
VSPSTKSAKSSSQYIDLNDERLRRRSFSSYSRSSSRRVSNSPSSTDRPPRSAKVLSLIAA
DDMDDFEDLQKGFKSAIDEEGLTWLPQLKSEKSRPVSDVGEDRGEGEQESIPDVHTPNVG
ASATPGSIHLTPEPAQNGSVSEGLEGSINNSRKKPSPKFFHHLSPQKEDKDQTEVIEYAE
DILDFETLQRKLESRPFVLYGHSLGVFSPTNPLRIKIARFLLHRRYSLLYNTLLTFYAIL
LAIRTYNPHNVVFLYRFSNWTDYFIFILSACFTGNDIAKIIAFGFWDDSEMFKAYGREYK
SILQRSGIMKLYIYLREKYGRKLIDFIIPFRIISPGEETKYQRSSLSTSLTKPYGAKENQ
RPFGTPRAFARSSWNRIDLVSSVSFWLGMFLSIKSYDTKTGIRIFKPLAILRILRLVNVD
TGMPSILRGLKYGIPQLVNVSSMLVYFWIFFGILGVQIFQGSFRRQCVWFNPEDPTDTYQ
YDMQFCGGYLDPVTKRKQNYIYEDGSEGSVSKGFLCPQYSKCVSNANPYNGRISFDNIVN
SMELVFVIMSANTFTDLMYYTMDSDEMAACLFFIVCIFVLTIWLLNLLIAVLVSSFEIAN
EEYKKKKFIYGSRKTGYVARIVTGYWKYFKLKANQTKFPNWSQKGLAIYSHVEFIFVILI
ICDIGMRASVKVSTSANCNNILLKTDRGISIVLFIESLARLVLYLPNMWKFLTKPSYVYD
FIISIITLVISCLAVEGVLGHMYAWLSIFHISRFYRVIISFNLTKKLWKQILSNGVMIWN
LSSFYFFFTPFLVAIIMAVYFEGVIPPEEMADQPFGMYSLPNSFLSLFIIGSTENWTDILY
ALQKHSPNISSTFFCSVFFIIWFLLSNSVILNIFIALISESMEVKEEEKRPQQIKHYLKF
VYPQKIQEYTHASLVARIRKKFFGGHRNEDTRDFKQFLMRGTAIMNIAQNMGELADEFKE
PPSENLFKKGLSKLTIGVPSLKRLRMFANNPFYKNSDVVFTETNDINGRTYILELNEYED
EKLDYLKKYPLFNYSYYFFSPQHRFRRFCQRLVPPSTGKRTDGSRFFEDSTDLYNKRSYF
HHIERDVFVFIFALATILLIVCSCYVTPLYRMHHKMGTWNWSSALDCAFIGAFSIEFIVK
TVADGFIYSPNAYLRNPWNFIDFCVLISMWINLIAYLKNNGNLSRIFKGLTALRALRCLT
ISNTARQTFNLVMFDGLNKIFEAGLISLSLLFPPFTVWGLSIFKGRLGTCNDGSLGRADCY
NEYSNSVFQWDIMSPRVYQQPYLHLDSFASAFSSLYQIISLEGWVDLLENMMNSSGIGTP
ATVMGSAGNALFLVLFNFLSMVFILNLFVSFIVNNQARTTGSAYFTIEEKAWLESQKLLS
QAKPKAIPNLIELSRVRQFFYQLAVEKKNFYYASFLQVVLYLHIIMLLSRSYNPGNLIGY
QGVYFMFSTSVFLIQEALHMCGEGPRLYFRQKWNSIRLSIIIAFIMNAVAFHVPASHYW
FHNIKGFFLLVIFLFIIPQNDTLTELLETAMASLPPILSLTYTWGVLFLVYAIALNQIFG
LTRLGSNTTDNINFRTVIKSMIVLFRCSFGEGWNYIMADLTVSEPYCSSDDNSTYTDCGS
ETYAYLLLMSWNIISMYIFVNMFVSLIIGNFSYVYRSGGSRSGINRSEIKKYIEAWSKFD
TDGTGELELSYLPRIMHSFDGPLSFKIWEGRLTIKSLVENYMEVNPDDPYDVKIDLIGLN
KELNTIDKAKIIQRKLQYRRFVQSIHYTNAYNGCIRFSDLLLQIPLYTAYSARECLGIDQ
YVHHLYILGKVDKYLENQRNFDVLEMVVTRWKFHCRMKRTIEPEWDVKDPTVSSHISNIN
VNLEPAPGILEREPIATPRMDYGVNNFMWSPRMNQDSTMEPPEEPIDNNDDSANDLIDR SEQ ID NO: 40
YGR224W
>sp|P50080|AZR1_YEAST Azole resistance protein 1 OS = Saccharomyces
cerevisiae (strain ATCC 204508 / S288c) GN = AZR1 PE = 1 SV = 1
MKGEPKTYSMSDLSYYGEKAQQQNEKQQKQYVVRRNSTQSTSKQNVSVVLEDNASESNEL
PKGFILYASLIALALSLFLAALDIMIVSTIIEEVAKQFGSYSEIGWLFTGYSLPNALLAL
IWGRIATPIGFKETMLFAIVIFEIGSLISALANSMSMLIGGRVIAGVGGCGIQSLSFVIG
STLVEESQRGILIAVLSCSFAIASVVGPFLGGVFTSSVTWRWCFYVNLPIGGLAFFLFLF
FYNPGLSTFQETMDNIRKFPSQFIEIVRNVAYHLLKIKGFSKLNGWRKPFMELIFMYDII
EFVFCSAGFTCILLAFTFGGNRYAWNSASIIILFIIGIVLVVLAGIYDFLVFPKFNIVKA
TPHYQPLMSWTNIKKPGIFTVNIALFLTCAGYISQFTYIVQYFQLIYNDSAWRAAVHLVA
CIISTVVTAILCGAITDKTRQIKPIIVISSIFGVVGAGILTLLNNNANNSAHIGLLILPG
VAFGGLAQSSMLASQIQLDKKSPTFRSDFVSITTFNTFCKNLGQALGGVISNTVFSAAAI
KKLTKANIQLPDGTTVDNLVIYRQTNFDGSHSKLGNIISESLTDVFYMALGFYALSLIFA
VFASNKKVTASLR SEQ ID NO: 41
YGR281W
>sp|P53049|YOR1_YEAST Oligomycin resistance ATP-dependent permease
YOR1 OS = Saccharomyces cerevisiae (strain ATCC 204508 / S288c)
GN = YOR1 PE = 1 SV = 1
MTITVGDAVSETELENKSQNVVLSPKASASSDISTDVDKDTSSSWDDKSLLPTGEYIVDR
NKPQTYLNSDDIEKVTESDIFPQKRLFSFLHSKKIPEVPQTDDERKIYPLFHTNIISNMF
FWWVLPILRVGYKRTIQPNDLFKMDPRMSIETLYDDFEKNMIYYFEKTRKKYRKRHPEAT
EEEVMENAKLPKHTVLRALLFTFKKQYFMSIVFAILANCTSGFNPMITKRLIEFVEEKAI
FHSMHVNKGIGYAIGACLMMFVNGLTFNHFPHTSQLTGVQAKSILTKAAMKKMFNASNYA
RHCFPNGKVTSFVTTDLARIEFALSFQPFLAGFPAILAICIVLLIVNLGPIALVGIGIFF
GGFFISLFAFKLILGFRIAANIFTDARVTMMREVLNNIKMIKYYTWEDAYEKNIQDIRTK
EISKVRKMQLSRNFLIAMAMSLPSIASLVTFLAMYKVNKGGRQPGNIFASLSLFQVLSLQ
MFFLPIAIGTGIDMIIGLGRLQSLLEAPEDDPNQMIEMKPSPGFDPKLALKMTHCSFEWE
DYELNDAIEEAKGEAKDEGKKNKKKRKDTWGKPSASTNKAKRLDNMLKDRDGPEDLEKTS TABLE 14-continued Sequences disclosed herein.

FRGFKDLNFDIKKGEFIMITGPIGTGKSSLLNAMAGSMRKTDGKVEVNGDLLMCGYPWIQ
NASVRDNIIFGSPFNKEKYDEVVRVCSLKADLDILPAGDMTEIGERGITLSGGQKARINL
ARSVYKKKDIYLFDDVLSAVDSRVGKHIMDECLTGMLANKTRILATHQLSLIERASRVIV
LGTDGQVDIGTVDELKARNQTLINLLQFSSQNSEKEDEEQEAVVAGELGQLKYESEVKEL
TELKKKATEMSQTANSGKIVADGHTSSKEERAVNSISLKIYREYIKAAVGKWGFIALPLY
AILVVGTTFCSLFSSVWLSYWTENKFKNRPPSFYMGLYSFFVFAAFIFMNGQFTILCAMG
IMASKWLNLRAVKRILHTPMSYIDTTPLGRILNRFTKDTDSLDNELTESLRLMTSQFANI
VGVCVMCIVYLPWFAIAIPFLLVIFVLIADHYQSSGREIKRLEAVQRSFVYNNLNEVLGG
MDTIKAYRSQERFLAKSDFLINKMNEAGYLVVVLQRWVGIFLDMVAIAFALIITLLCVTR
AFPISAASVGVLLTYVLQLPGLLNTILRAMTQTENDMNSAERLVTYATELPLEASYRKPE
MTPPESWPSMGEIIFENVDFAYRPGLPIVLKNLNLNIKSGEKIGICGRTGAGKSTIMSAL
YRLNELTAGKILIDNVDISQLGLFDLRRKLAIIPQDPVLFRGTIRKNLDPFNERTDDELW
DALVRGGAIAKDDLPEVKLQKPDENGTHGKMHKFHLDQAVEEEGSNFSLGERQLLALTRA
LVRQSKILILDEATSSVDYETDGKIQTRIVEEFGDCTILCIAHRLKTIVNYDRILVLEKG
EVAEFDTPWTLFSQEDSIFRSMCSRSGIVENDFENRS

SEQ ID NO: 42
YHL016C
>sp|P33413|DUR3_YEAST Urea active transporter OS = Saccharomyces
cerevisiae (strain ATCC 204508 / S288c) GN = DUR3 PE = 1 SV = 2
MGEFKPPLPQGAGYAIVLGLGAVFAGMMVLTTYLLKRYQKEIITAEEFTTAGRSVKTGLV
AAAVVSSWIWCSTLLTSSTKEYADGIFGGYAYAAGACFQIIAFAILAIKTKQMAPNAHTY
LELVRTRYGKIGHGCYLFYAIATNILVTSMLLTSGSAVFSDLTGMNTIASCFLLPVGVN
YTLFGGIKATFLTDYMHTCVIIIIVLVFAFKVYATSDVLGSPGKVYDLVREAAKRHPVDG
NYQGEYMTMTSKSAGILLIINLIGNFGTVFLDNGYWNKAISASPAASLKAYAIGGLAWFA
VPSLISLTMGLACLAVETSPNFPTYPDPLTSFQANSGLVLPAAAIAIMGKGGAVASLLMI
FMAVTSAMSAELIAVSSVFTYDIYREYIDPRASGKKLIYTSHVACIFFGLAMSGFSVGLY
YGGISMGYIYEMMGIIISSAVLPVVLTLCSKDMNLVAAVVSPILGTGLAIMSWLVCTESL
YKELTVDTTFMDYPMLTGNLVALLSPAIFIPILTYVFKPQNFDWEKMKDITRVDETAELV
QADPDIQLYDAEANDKEQEEETNSLVSDSEKNDVRVNNEKLIEPNLGVVISNAIFQEDDT
QLQNELDEEQRELARGLKIAYFLCVFFALAFLVVWPMPMYGSKYIFSKKFFTGWVVVMII
WLFFSAFAVCIYPLWEGRHGIYTTLRGLYWDLSGQTYKLREWQNSNPQDLHVVTSQISAR
AHRQSSHFGQVDEII SEQ ID NO: 43
YIL088C
>sp|P40501|AVT7_YEAST Vacuolar amino acid transporter 7
OS = Saccharomyces cerevisiae (strain ATCC 204508 / S288c) GN = AVT7
PE = 1 SV = 1
MEATSSALSSTANLVKTIVGAGTLAIPYSFKSDGVLVGVILTLLAAVTSGLGLFVLSKCS
KTLINPRNSSFFTLCMLTYPTLAPIFDLAMIVQCFGVGLSYLVLIGDLFPGLFGGERNYW
IIASAVIIPLCLVKKLDQLKYSSILGLFALAYISILVFSHFVFELGKGELTNILRNDIC
WWKIHDFKGLLSTFSIIIFAFTGSMNLFPMINELKDNSMENITFVINNSISLSTALFLIV
GLSGYLTFGNETLGNLMLNYDPNSIWIVIGKFCLGSMLILSFPLLFHPLRIAVNNVIIWI
EITYGGANPEEDPQVSEYTRASNLRPISMTVEDPAQPSDALDATSYNEQECLLPNGNFDN
GSIESQENNNDERGTMAVAGDNEHHAPFVKSRFYWITALLLISMYTLALSVQSFALVLSF
VGATGSTSISFTLPGLLGYKLIGLDSLAIGKMIPPKDRFYKRCSLLLVFYGLSVMFLSLY
VTVFNRSDEA SEQ ID NO: 44
YJL093C
>sp|P40310|TOK1_YEAST Outward-rectifier potassium channel TOK1
OS = Saccharomyces cerevisiae (strain ATCC 204508 / S288c) GN = TOK1
PE = 1 SV = 1
MTRFMNSFAKQTLGYGNMATVEQESSAQAVDSHSNNTPKQAKGVLAEELKDALRFRDERV
SIINAEPSSTLFVFWFVVSCYFPVITACLGPVANTISIACVVEKWRSLKNNSVVTNPRSN
DTDVLMNQVKTVFDPPGIFAVNIISLVLGFTSNIILMLHFSKKLTYLKSQLINITGWTIA
GGMLLVDVIVCSLNDMPSIYSKTIGFWFACISSGLYLVCTIILTIHFIGYKLGKYPPTFN
LLPNERSIMAYTVLLSLWLIWGAGMFSGLLHITYGNALYFCTVSLLTVGLGDILPKSVGA
KIMVLIFSLSGVVLMGLIVFMTRSIIQKSSGPIFFFHRVEKGRSKSWKHYMDSSKNLSER
EAFDLMKCIRQTASRKQHWFSLSVTIAIFMAFWLLGALVFKPAENWSYFNCIYFCFLCLL
TIGYGDYAPRTGAGRAFFVIWALGAVPLMGAILSTVGDLLFDISTSLDIKIGESFNNKVK
SIVFNGRQRALSFMVNTGEIFEESDTADGDLEENTTSSQSSQISEFNDNNSEENDSGVTS
PPASLQESFSSLSKASSPEGILPLEYVSSAEYALQDSGTCNLRNLQELLKAVKKLHRICL
ADKDYTLSFSDWSYIHKLHLRNITDIEEYTRGPEFWISPDTPLKFPLNEPHFAFMMLFKN
IEELVGNLVEDEELYKVISKRKFLGEHRKTL SEQ ID NO: 45
YJL094C
>sp|P40309|KHA1_YEAST K(+)/H(+) antiporter 1 OS = Saccharomyces
cerevisiae (strain ATCC 204508 / S288c) GN = KHA PE = 1 SV = 1
MANTVGGILSGVNPFHYNSSSPLTLFLFQACLILLVCNLIHIPFSMMRQPKVISEVISGV
ILGPTIFGQIPNYTNTIFPTSSIPGLNLVANLGIILFMFFLGLEVDIAFIKKHLKKALVI
GIVTLAVPFGFGCLLAIPLFHTYANKTEGERHIKFSVFMVFIAVSISVTAFPVLCRILNE
LRLIKDRAGIVVLAAGIINDIMGWILLALSIILSSAEGSPVNTVYILLITFAWFLIYFFP
LKYLLRWVLIRTHELDRSKPSPLATMCILFIMFISAYFTDIIGVHPIFGAFIAGLVVPRD
DHYVVKLTERMEDIPNIVFIPIYFAVAGLNVDLTLLNEGRDWGYVFATIGIAIFTKIISG
TLTAKLTGLFWREATAAGVLMSCKGIVEIVVLTVGLNAGIISRKIFGMFVLMALVSTFVT TABLE 14-continued Sequences disclosed herein.

TPLTQLVYPDSYRDGVRKSLSTPAEDDGAADGLDSEGVDKTEINTQLNSLADVSKYRIGE
LTTVINTTEAISPSLKLLNYLSLGVSPKPKNNKHKNETSLSRMTTATDSTLKSNTFKIKK
MVIHIWSKSVDDVDTNLSVIDEKLTPFEGVGALRAIHLRLLTERTTDLLQSSSLYNDDPHF
TANTDSLLQIFDIFSNLSKIPFSSEVIFSTMREKAANIATMKMDSTDLILLPLKGASYEY
RGSPVFIDEKYANFDHIYSHLLGLNELSSTFFKSIFQSLKANFAVQISNTYGRLNADRFK
RKRFNLLLPKPYLTQSDYLGLYLLLLICYRDGYNNDNASCSIFINSKNIDFAKDLSTAFA
EHDWLNESTIKIVDIPFETKVPEEAIEKPSFIETVLDVGLSDTALADIEETTFIIGEDLP
DESEPFSEEVRTVIFEGSNRRFDTLIVHHFSSE

SEQ ID NO: 46
YJL108C
>sp|P42946|PRM10_YEAST Pheromone-regulated membrane protein 10
OS = Saccharomyces cerevisiae (strain ATCC 204508 / S288c) GN = PRM10
PE = 1 SV = 1
MIVSFGDATTRTSEVQLVRCTQGLNLWKLHQVHAVYKRVVHDTLGADEGNALLDQILADT
NLYPPWMCVLLYAFCSAMVTPYAFGGDWVNLAISFFMGLCVGSLQFILSQKSYMYSNVFE
ISASIVVSFCGRAFGSIPRSHICFGAVTQGSLALILPGYIILCGALELQSRSLVAGAVRM
FYAIIYSLFLGFGITLGSALFGWMYHNATNEISCPQLISPWFRFLFVPAFTISISLLNQA
HISQLPVMVFISCTGYVVTYWAGKHFANSTEFTAALAAFVIGVLGNLYSRIWKGLAVSAM
LPAIFVQVPSGIASQNSLLSGLQSANTIVNANETITTSTSDPSSSMSFGMTMIQVCVGIS
VGLFASSLFVYPFGKKKTGLFSL SEQ ID NO: 47
YJL212C
>sp|P40897|OPT1_YEAST Oligopeptide transporter 1 OS = Saccharomyces
cerevisiae (strain ATCC 204508 / S288c) GN = OPT1 PE = 1 SV = 1
MSTIYRESDSLESEPSPTPTTIPIQINMEEEKKDAFVKNIDEDVNNLTATTDEEDRDPES
QKFDRHSIQEEGLVWKGDPTYLPNSPYPEVRSAVSIEDDPTIRLNHWRTWFLTTVFVVVF
AGVNQFFSLRYPSLEINFLVAQVVCYPIGRILALLPDWKCSKVPFFDLNPGPFTKKEHAV
VTIAVALTSSTAYAMYILNAQGSFYNMKLNVGYQFLLVWTSQMIGYGAAGLIRRWVVNPA
SSIWPQTLISVSLFDSLHSRKVEKTVANGWTMPRYRFFLIVLIGSFIWYWVPGFLFTGLS
YFNVILWGSKTRHNFIANTIFGTQSGLGALPITFDYTQVSQAMSGSVFATPFYVSANTYA
SVLIFFVIVLPCLYFTNTWYAKYMPVISGSTYDNTQNKYNVTKILNEDYSINLEKYKEYS
PVFVPFSYLLSYALNFAAVIAVFVHCILYHGKDIVAKFKDRKNGGTDIHMRIYSKNYKDC
PDWWYLLLQIVMIGLGFVAVCCFDTKFPAWAFVIAILISLVNFIPQGILEAMTNQHVGLN
IITELICGYMLPLRPMANLLFKLYGFIVMRQGLNLSRDLKLAMYMKVSPRLIFAVQIYAT
IISGMVNVGVQEWMMHNIDGLCTTDQPNGFTCANGRTVFNASIIWSLPKYLFSSGRIYNP
LMWFFLIGLLFPLAVYAVQWKFPKFKFAKHIHTPVFFTGPGNIPPSTPYNYSLFFAMSFC
LNLIRKRWRAWFNKYNFVMGAGVEAGVAISVVIIFLCVQYPGGKLSWWGNNVWKRTYDND
YKKFYTLKKGETFGYDKWW SEQ ID NO: 48
YJR106W
>sp|P47144|ECM27_YEAST Protein ECM27 OS = Saccharomyces cerevisiae
(strain ATCC 204508 / S288c) GN = ECM27 PE = 1 SV = 2
MDWAINVAHPRLLYKDPKLSVTFIVPSLFHIIIAFVLLGICASDFLCPNVAHISDPNSLR
SNGSLVSKTASHASHTGALMAVLLSWCNSSPDLFSNLMSWATSTRETRSTSVSLSIGEVL
GACGIILCIVEGSIFIIMSRTHIEISQIQKLSIMRDLLFSLAAMCVMSYVSLMNQVTVLN
CLLMAFLYAFYLVVKLTFKLNHSAETPDETAADTSLRENSVSPFLDDSLMASGLLPPIQP
GFDISNSITHGIKPSLLSAMDFNSFLSMLENSSLEEDDSRNEMAELNTLRSMTPGQHWSA
SATVAGEATSAGRPFSEPTNAFTEYRDSERAINSSPAVFAPYRDNPDDEESQEQVLLETT
THGHFGAQEMRRFSKRSLGWIIKIFIPHLSNFSQKSISDAIFSIITVPFFIIFKLSCPQP
PSDILSYDPILNRYSLTTLPIILLFIQSITAPFLLCSILSVLLTYHLGYLVYLFPLILAM
ALILLLTAFITKVNLHNKFTLSLDSSNILQEKLQKRKLLERLNTSIQIIFLAIGIINIII
WISLLANSLIEMMEIYQKILGLSKAILGLTIFAWGNSVGDLISNISMCRLYKTQTHYQDR
VRLATKFFMISCASCLGGVMLNSMGGIGFSGLVSMLFIGAFNDNEWWFLRKVKLQETSQL
DNILNYKFIVSCVFIILQIILLLLFFGGPNNIKRRLTKEMKLVGISMCGLWALATLINIL
LELFS SEQ ID NO: 49
YJR160C
>sp|P0CE00|MPH3_YEAST Alpha-glucosides permease MPH3
OS = Saccharomyces cerevisiae (strain ATCC 204508 / S288c) GN = MPH3
PE = 1 SV = 1
MKNLSFLINRRKENTSDSNVYPGKAKSHEPSWIEMDDQTKKDGLDIVHVEFSPDTRAPSD
SNKVITEIEDATEDAKEADESERGMPLATALNTYPKAAAWSLLVSTTLIMEGYDTAILGA
FYALPIFQRKFGSQNDKTGEWEISASWQIGLTLCYMAGEIVGLQLTGPSVDLVGNRYTLI
IALFFLAAFTFILYFCNSLGMIAVGQALCGMPWGCFQCLTVSYASEICPLALRYYLTTYS
NLCWLFGQLFAAGIMKNSQKKYADSELGYKLPFALQWILPVPLALGIFFAPESPWWLVKK
GRFDEARRSLRRTLSGKGPEKEILVTLEVDKIKVTIDKEKRLTSKEGSYSDCFEDKINRR
RTRITCLCWAGQATCGSILIGYSTYFYEKAGVSTEMSFTFSIIQYCLGICATFLSWWASK
YFGRYDLYAFGLAFQTIVFFIIGGLGCSSTHGSKMGSGSLLMAVAFFYNLGIAPVVPCLV
SEMPSSRLRTKTIILARNTYNVVSIICSVLILYQLNSKKWNWGAKSGFFWGVLCFCTLIW
AVVDLPETAGKTFVEINELFKLGVSARKFKSTKVDPFVVKTPPKDVSHNDPKGDIEASIA
EE TABLE 14-continued Sequences disclosed herein.

SEQ ID NO: 50
YKL064W
>sp|P35724|MNR2_YEAST Manganese resistance protein MNR2
OS = *Saccharomyces cerevisiae* (strain ATCC 204508 / S288c) GN = MNR2
PE = 1 SV = 1
MSTDNSQKDEGVPLLSPYSSSPQLRKKKRNQKRRKDKFVGHLKSDSRRPTQLLHDNLQHN
HGQITDFDQIDSWGMLHESDSTSNDIIKSEDPSLKGAFIDHRPSMSQPREGPQSVSSTVQ
PQPIMKFSTPSYKKPAGLRPSDQNRSLVSDLSPSELESWLKRRKSVHKSFVDENSPTDRR
QSNANNDVVIDVDALMNHVNNNASTGVNDNSKRRKKKRGSDDSSNKNSKSTSSDSNDEED
EYNSRPSSSLSSNNSSLDDVCLVLDDEGSEVPKAWPDCTVLEEFSKEETERLRSQAIQDA
EAFHFQYDEDEEDGTSNEDGILFSKPIVINIDVPELGNRRVNETENLKNGRLRPKRIAPW
HLIQRPMVLGSNSTKDSKSRIQSGLQDNLLVGRNIQYPPHIISNNPEHFRFTYFRVDLDS
TVHSPTISGLLQPGQKFQDLFVASIYSQDNSAGHIKTHPNSPTPGIKAETVSQLQGLTAK
NPSTLSSMSVANIEDVPPFWLDVSNPTEEEMKILSKAFGIHPLTTEDIFLGEVREKVELF
RDYYLICFRSFDIVAEKHVRRRRKEKQESAILDHESISRRKSQAYGATMSNESNANNNNS
TSNASRSKWLPSILRARRRSSANRTTNTSSSSYKRRVKSEKKKMEENEKFKRKSGDRHKP
REGELEPLNVYIIVFRTGVLTFHFAPTPHPINVRRRARLLKDYLNVTSDWIAYALIDDIT
DAFAPMIELIEDEVYEIEDAILKMHQSDDSSDSDSSDSDSDSGASDEDAFPPFDVYSKKTS
YSSAKSSVSSRSMSTSEASFNANLIGWKRKGDMLRRIGECRKRVMSILRLLGSKADVIKG
FAKRYNEQWEASPQSEIAMYLGDIQDHIVTMVSSLNHYEKLLSRSHSNYLAQINIDMTKV
NNDMNDVLGKITILGTIVLPMNVITGLWGMNVIVPGQYRDSLTWFIGIVLFMCMLACSAY
MYTKRRFGF SEQ ID NO: 51
YKR050W
>sp|P28584|TRK2_YEAST Low-affinity potassium transport protein
OS = *Saccharomyces cerevisiae* (strain ATCC 204508 / S288c) GN = TRK2
PE = 1 SV = 1
MPTAKRTSSRASLALPFQLRLVHKKSWGHRLRDFISGFLKSCRPIAKYVFPNFIVVHYIY
LITLSIIGSILLYPCKNTAFIDVLFLAAGASTQGGLATKSTNDFNLYQQIVVYVITLLST
PILIHGFLAFVRLYWFERYFDNIRDISKQNFKLRRTMTLQQRELSGSSGNAARSRSFKDN
LFRGKFVSREDPRQSASDVPMDSPDTSALSSISPLNVSSSKEESSDTQSSPPNFSSKRQP
SDVDPRDIYKSIMMLQKQQEKSNANSTDSFSSETNGPAFIVQERHERRAPHCSLKRHSVL
PSSQELNKLAQTKSFQKLLGLRRDEGDHDYFDGAPHKYMVTKKKKISRTQSCNIPTYTAS
PSPKTSGQVVENHRNLAKSAPSSFVDEEMSFSPQESLNLQFQAHPPKPKRREGDIGHPFT
RTMSTNYLSWQPTFGRNSVFIGLTKQQKEELGGVEYRALRLLCCILMVYYIGFNILAFVT
IVPWACTRHHYSEIIRRNGVSPTWWGFFTAMSAFSNLGLSLTADSMVSFDTAPYPLIFMM
FFIIIGNTGFPIMLRFIIWIMFKTSRDLSQFKESLGFLLDHPRRCFTLLFPSGPTWWLFT
TLVVLNATDWILFIILDFNSAVVRQVAKGYRALMGLFQSVCTRTAGFNVVDLSKLHPSIQ
VSYMLMMYVSVLPLAISIRRTNVYEEQSLGLYDSGQDDENITHEDDIKETDHDGESEERD
TVSTKSKPKKQSPKSFVGAHLRRQLSFDLWYLFLGLFIICICEGRKIEDVNKPDFNVFAI
LFEVVSAYGTVGLSLGYPNTNTSLSAQFTVLSKLVIIAMLIRGRNRGLPYTLDRAIMLPS
DKLEQIDRLQDMKAKGKLLAKVGEDPMTTYVKKRSHKLKKIATKFWGKH SEQ ID NO: 52
YKR105C
>sp|P36172|VBA5_YEAST Vacuolar basic amino acid transporter 5
OS = *Saccharomyces cerevisiae* (strain ATCC 204508 / S288c) GN = VBA5
PE = 3 SV = 1
MEETKYSSQQEIEGACGSDASLNARGSNDSPMGLSLYLCLASLILVLFITALDILIVGTI
IDVVAEQFGNYSKTGWLVTGYSLPNAILSLIWGRFASIIGFQHSLILAILIFEAGSLIAA
LASSMNMLIFGRVVAGVGGSGLQTLCFVIGCTMVGERSRPLVISILSCAFAVAAIVGPII
GGAFTTHVTWRWCFYINLPIGGLAIIMFLLTYKAENKGILQQIKDAIGTISSFTFSKFRH
QVNFKRLMNGIIFKFDFFGFALCSAGLVLFLLGLTFGGNKYSWNSGQVITYLVLGVLLFI
FSLVYDFFLFDKFNPEPDNISYRPLLLRRLVAKPAIIIVNMVTFLLCTGYNGQMIYSVQF
FQLIFASSAWKAGLHLIPIVITNVIAAIASGVITKKLGLVKPLLIFGGVLGVIGAGLMTL
MTNTSTKSTQIGVLLLPGFSLGFALQASLMSAQLQITKDRPEAAMDFIEVTAFNTFMKSL
GTTLGGVLSTTVFSASFHNKVSRAHLEPYEGKTVDDMILYRLQNYDGSHSTIGNILSDSI
KNVFWMDLGFYALGFLFCSFSSNKKLIIPKKDDTPEDNLEDK SEQ ID NO: 53
YKR106W
>sp|P36173|GEX2_YEAST Glutathione exchanger 2 OS = *Saccharomyces cerevisiae* (strain ATCC 204508 / S288c) GN = GEX2 PE = 1 SV = 1
MSSSVVGASSNKKSGIRQSCEIIERERHSNDDTYSMTSTFFKLKENEIMSAQFDSLKYKI
LLISTAFVCGFGISLDYTLRSTYTGYATNSYSEHSLLSTVQVINAVVSVGSQVVYSRLSD
HFGRLRLFLVATIFYIMGTIIQSQATRLTMYAAGSVFYNCGYVGTNLLLTLILSDFSSLK
WRMFYQYASYWPYIIIPWISGNIITAANPQKNWSWNIAMWAFIYPLSTLPIIFLILYMKY
KSSKTAEWRSLKEQARKERTGGLFENLVFLFWKLDIVGILLITVSLGCILVFLTLANETS
QKWHNSKIIATLVSGGCLFFIFLYWEAKFAKSPLLPFKLLSDRGIWAPLGVTFFNFFTFF
ISCDYLYPVLLVSMKESSTSAARIVNLPDFVAATASPFYSLLVAKTRKLKLSVIGGCAAW
MVCMGLFYKRGGSGSHEGVIAASVIMGLSGLLCSNSVIVILQAMTTHSRMAVITGIQYT
FSKLGAAIGASVSGAIWTQTMPNQLYKNLGNDTLAEIAYASPYTFISDYPWGSPERDAVV
ESYRYVQRIIMTVGLACTVPFFTFTMFMRNPELIDKATHEEFTEDGLVVLPDEENIFSQI
KALFRHNRSNKKSGC TABLE 14-continued Sequences disclosed herein.

SEQ ID NO: 54
YLR447C
>sp|P32366|VA0D_YEAST V-type proton ATPase subunit d
OS = Saccharomyces cerevisiae (strain ATCC 204508 / S288c) GN = VMA6
PE = 1 SV = 2
MEGVYFNIDNGFIEGVVRGYRNGLLSNNQYINLTQCDTLEDLKLQLSSTDYGNFLSSVSS
ESLTTSLIQEYASSKLYHEFNYIRDQSSGSTRKFMDYITYGYMIDNVALMITGTIHDRDK
GEILQRCHPLGWFDTLPTLSVATDLESLYETVLVDTPLAPYFKNCFDTAEELDDMNIEII
RNKLYKAYLEDFYNFVTEEIPEPAKECMQTLLGFEADRRSINIALNSLQSSDIDPDLKSD
LLPNIGKLYPLATFHLAQAQDFEGVRAALANVYEYRGFLETGNLEDHFYQLEMELCRDAF
TQQFAISTVWAWMKSKEQEVRNITWIAECIAQNQRERINNYISVY SEQ ID NO: 55
YML116W
>sp|P13090|ATR1_YEAST Aminotriazole resistance protein
OS = Saccharomyces cerevisiae (strain ATCC 204508 / S288c) GN = ATR1
PE = 1 SV = 2
MGNQSLVVLTESKGEYENETELPVKKSSRDNNIGESLTATAFTQSEDEMVDSNQKWQNPN
YFKYAWQEYLFIFTCMISQLLNQAGTTQTLSIMNILSDSFGSEGNSKSWLMASFPLVSGS
FILISGRLGDIYGLKKMLLVGYVLVIIWSLICGITKYSGSDIFFIISRAFQGLGIAFVLP
NVLGIIGNIYVGGTFRKNIVISFVGAMAPIGATLGCLFAGLIGTEDPKQWPWAFYAYSIA
AFINFVLSIYAIPSTIPTNIHHFSMDWIGSVLGVIGLILLNFVWNQAPISGWNQAYIIVI
LIISVIFLVVFIIYEIRFAKTPLLPRAVIKDRHMIQIMLALFFGWGSFGIFTFYYTQFQL
NIRQYTALWAGGTYFMFLIWGIIAALLVGFTIKNVSPSVFLFFSMVAFNVGSIMASVTPV
HETYFRTQLGTMIILSFGMDLSFPASSIIFSDNLPMEYQGMAGSLVNTVVNYSMSLCLGM
GATVETQVNSDGKHLLKGYRGAQYLGIGLASLACMISGLYMVESFIKGRRARAAAEYDCT
VA SEQ ID NO: 56
YMR034C
>sp|Q05131|YMS4_YEAST Uncharacterized membrane protein YMR034C
OS = Saccharomyces cerevisiae (strain ATCC 204508 / S288c) GN = YMR034C
PE = 1 SV = 1
MKTQYSLIRKIWAHSVTEFLKSQWFFICLAILIVIARFAPNFARDGGLIKGQYSIGYGCV
AWIFLQSGLGMKSRSLMANMLNWRAHATILVLSFLITSSIVYGFCCAVKAANDPKIDDWV
LIGLILTATCPTTVASNVIMTTNAGGNSLLCVCEVFIGNLLGAFITPALVQMFTNRAPFA
YGNPATGNGIGALYGRVMKQVGLSVFVPLFVGQVIQNCFPKGTAYYLGFLKKYHIKIGSY
MLLLIMFSSFSTAFYQDAFTSVSHVCIIFLCFFNLGIYIFFTGLSYLCARPWFILKLFPH
EPIEGKSTRLYRYSYNIFRPFYYSKEDAICIMFCGPAKTAALGVSLITSQYGDKKEHLGK
LLVPLVLYQVEQVMTANFFVSLFKRWIQKDAQADGSESSCANENEEVDLEKIISIGTGEN
QSVLSNNVPYTQPR SEQ ID NO: 57
YMR056C
>sp|P04710|ADT1_YEAST ADP, ATP carrier protein 1 OS = Saccharomyces
cerevisiae (strain ATCC 204508 / S288c) GN = AAC1 PE = 1 SV = 1
MSHTETQTQQSHFGVDFLMGGVSAAIAKTGAAPIERVKLLMQNQEEMLKQGSLDTRYKGI
LDCFKRTATHEGIVSFWRGNTANVLRYFPTQALNFAFKDKIKSLLSYDRERDGYAKWFAG
NLFSGGAAGGLSLLFVYSLDYARTRLAADARGSKSTSQRQFNGLLDVYKKTLKTDGLLGL
YRGFVPSVLGIIVYRGLYFGLYDSFKPVLLTGALEGSFVASPLLGWVITMGASTASYPLD
TVRRRMMMTSGQTIKYDGALDCLRKIVQKEGAYSLFKGCGANIFRGVAAAGVISLYDQLQ
LIMFGKKFK SEQ ID NO: 58
YMR253C
>sp|Q04835|YM87_YEAST Uncharacterized membrane protein YMR253C
OS = Saccharomyces cerevisiae (strain ATCC 204508 / S288c) GN = YMR253C
PE = 1 SV = 1
MNPSVPKVMKRENNTHLLVSKEMNDTSLQLPSTTRSLSPKESNSNEDFNVDGNETTLQRI
SKDYLKPNIGLVLLTVSYFFNSAMVVSTKVLENDPDDIANDRQIKPLQILLVRMVITYIG
TLIYMYINKSTISDVPFGKPEVRKWLVLRGCTGFFGVFGMYYSLMYLTISDAVLITFLAP
SLTIFLSWVILRERFTKVEALGSLISLLGVVLIVRPSFLFGTPELTDSSSQIVESSDPKS
RLIATLVGLWGVLGMSCVYIIIRYIGKRAHAIMSVSYFSLITAIVSPIGINTIPSMKFQI
PHSKKQWILFGNLGVSGFIFQLLLTMGIQRERAGRGSLMTYTQLLYAVFWDVALYKHWPN
IWSWIGMIIIISATLWVIRAANNETTAKDLTPIIDDEENSIPLTEFDLSDSK SEQ ID NO: 59
YNL065W
>sp|P53943|AQR1_YEAST Probable transporter AQR1 OS = Saccharomyces
cerevisiae (strain ATCC 204508 / S288c) GN = AQR1 PE = 1 SV = 1
MSRSNSIYTEDIEMYPTHNEQHLTREYTKPDGQTKSEKLNFEGAYINSHGTLSKTTTREI
EGDLDSETSSHSSDDKVDPTQQITAETKAPYTLLSYGQKWGMVAILTMCGFWSSLGSPIY
YPALRQLEKQFNVDENMVNVTVVVYLLFQGISPTVSGGLADCFGRRPIILAGMLIYVIAS
IGLACAPSYGVIIFLRCIQSIGISPTIAISSGVVGDFTLKHERGTFVGATSGFVLLGQCF
GSLIGAVLTARWDWRAIFWFLTIGCGSCFLIAFLILPETKRTIAGNLSIKPKRFINRAPI
FLLGPVRRRFKYDNPDYETLDPTIPKDLSSAGKILVLPEIILSLFPSGLLFAMWTLMLS
SISSGLSVAPYNYHLVIIGVCYLPGGIGGLMGSFFTGRIIDMYFKRKIKKFEQDKANGLI TABLE 14-continued Sequences disclosed herein.

PQDAEINMFKVRLVCLLPQNFLAVVAYLLFGWSIDKGWRIESILITSFVCSYCAMSTLST
STTLLVDLYPTKSSTASSCFNFVRCSLSTIFMGCFAKMKAAMTVGGTFTFLCALVFFFNF
LMFIPMKYGMKWREDRLLKQQRQSWLNTLAVKAKKGTKRDQNDNHN

SEQ ID NO: 60
YNL070W
>sp|P53507|TOM7_YEAST Mitochondrial import receptor subunit TOM7
OS = Saccharomyces cerevisiae (strain ATCC 204508 / S288c) GN = TOM7
PE = 1 SV = 2
MSFLPSFILSDESKERISKILTLTHNVAHYGWIPFVLYLGWAHTSNRPNFLNLLSPLPSV SEQ ID NO: 61
YNL083W
>sp|D6W196|CMC1_YEAST Truncated non-functional calcium-binding
mitochondrial carrier SAL1-1 OS = Saccharomyces cerevisiae (strain
ATCC 204508 / S288c) GN = SAL1 PE = 1 SV = 2
MLLKNCETDKQRDIRYACLFKELDVKGNGQVTLDNLISAFEKNDHPLKGNDEAIKMLFTA
MDVNKDSVVDLSDFKKYASNAESQIWNGFQRIDLDHDGKIGINEINRYLSDLDNQSICNN
ELNHELSNEKVNKFSRFFEWAFPKRKANIALRGQASHKKNTDNDRSKKTTDSDLYVTYDQ
WRDFLLLVPRKQGSRLHTAYSYFYLFNEDVDLSSEGDVTLINDFIRGFGFFIAGGISGVI
SRTCTAPFDRLKVFLIARTDLSSILLNSKTDLLAKNPNADINKISSPLAKAVKSLYRQGG
IKAFYVGNGLNVIKVFPESSIKFGSFEVTKKIMTKLEGCRDTKDLSKFSTYIAGGLAGMA
AQFSVYPIDTLKFRVQCAPLDTKLKGNNLLFQTAKDMFREGGGQIILQRCHSRYSGHISL
CCIRFGDFFCLKKMVYCQTGKDPEPTTRSGHSKQPGCTSNGCIQWNCRSFCCLSNQSFKN
KTTSPRNICTSLCV SEQ ID NO: 62
YNL095C
>sp|P53932|YNJ5_YEAST Uncharacterized transporter YNL095C
OS = Saccharomyces cerevisiae (strain ATCC 204508 / S288c) GN = YNL095C
PE = 1 SV = 1
MVHITLGQAIWVSVKPIIKIYLIIGVGFLMAKMGILTVEATRIISDIVLTVLLPSLSFNK
IVANIEDKDIKSVGIICLSALLIFGSGFFFAYVVRLFLPVPKQWYGGILAGGMFPNISDL
PIAYLQSMDQGLVFSEEEGNKGVANVIIFLTMFLICIFNLGGFRLIESDFEYNDDESAVR
VSETTKTQPAVSANTTNTDTSERFFSNEQQLFNNKYTARDSLTEAIGTKGENADVPPISR
RSTNSIAPLSLPDTSSNSKITKPVQVKARNTIACTQSEESQATRGSNPLDSQSSASTIHS
YNTSESYESSIDTMRARRTASQPRAYNTTTLLEENCLDEKCPKNMSMAALEPIRSIDMRA
LPSQNIHHLIREYSNVDQYGHQRRNSSLRGADMNDVHSISSNSTLQTIKTANLTRILTSD
ATVSKKDIETSGESLPQWMRKFSLTPLLVFFLKNCLRPCSMAVIIALTVAFIPWVKALFV
TTANTPHISQAPDNAPPLSFFMDFTGYVGAACVPFGLILLGATLGRLKIGNLYPGFWKAA
VTLVILRQCVMPIFGVLWCDRLVKAGWVNWQDDRMLLFVIAISWNLPTMTTLIYFTASFT
PPETTAPIQMECVSFFLMLQYPLMVVSLPFLVSYFLKVQMNL SEQ ID NO: 63
YNL121C
>sp|P07213|TOM70_YEAST Mitochondrial import receptor subunit TOM70
OS = Saccharomyces cerevisiae (strain ATCC 204508 / S288c) GN = TOM70
PE = 1 SV = 2
MKSFITRNKTAILATVAATGTAIGAYYYYNQLQQQQQRGKKNTINKDEKKDTKDSQKETE
GAKKSTAPSNPPIYPVSSNGEPDFSNKANFTAEEKDKYALALKDKGNQFFRNKKYDDAIK
YYNWALELKEDPVFYSNLSACYVSVGDLKKVVEMSTKALELKPDYSKVLLRRASANEGLG
KFADAMFDLSVLSLNGDFNDASIEPMLERNLNKQAMSKLKEKFGDIDTATATPTELSTQP
AKERKDKQENLPSVTSMASFFGIFKPELTFANYDESNEADKELMNGLSNLYKRSPESYDK
ADESFTKAARLFEEQLDKNNEDEKLKEKLAISLEHTGIFKFLKNDPLGAHEDIKKAIELF
PRVNSYIYMALIMADRNDSTEYYNYFDKALKLDSNNSSVYYHRGQMNFILQNYDQAGKDF
DKAKELDPENIFPYIQLACLAYRENKFDDCETLFSEAKRKFPEAPEVPNFFAEILTLRND
FDKALKQYDLAIELENKLDGIYVGIAPLVGKATLLTRNPTVENFIEATNLLEKASKLDPR
SEQAKIGLAQMKLQQEDIDEAITLFEESADLARTMEEKLQAITFAEAAKVQQRIRSDPVL
AKKIQETLAKLREQGLM SEQ ID NO: 64
YNL142W
>sp|P41948|MEP2_YEAST Ammonium transporter MEP2 OS = Saccharomyces
cerevisiae (strain ATCC 204508 / S288c) GN = MEP2 PE = 1 SV = 1
MSYNFTGTPTGEGTGGNSLTTDLNTQFDLANMGWIGVASAGVWIMVPGIGLLYSGLSRKK
HALSLLWASMMASAVCIFQWFFWGYSLAFSHNTRGNGFIGTLEFFGFRNVLGAPSSVSSL
PDILFAVYQGMFAAVTGALMLGGACERARLFPMMVFLFWMTIVYCPIACWVWNAEGWLV
KLGSLDYAGGLCVHLTSGHGGLVYALILGKRNDPVTRKGMPKYKPHSVTSVVLGTVFLWF
GWMFFNGGSAGNATIRAWYSIMSTNLAAACGGLTWMVIDYFRCGRKWTTVGLCSGIIAGL
VGITPAAGFVPIWSAVVIGVVTGAGCNLAVDLKSLLRIDDGLDCYSIHGVGGCIGSVLTG
IPAADYVNATAGSYISPIDGGWINHHYKQVGYQLAGICAALAWTVTVTSILLLTMNAIPF
LKLRLSADEEELGTDAAQIGEFTYEESTAYIPEPIRSKTSAQMPPPHENIDDKIVGNTDA
EKNSTPSDASSTKNTDHIV TABLE 14-continued Sequences disclosed herein.

SEQ ID NO: 65
YOL020W
>sp|P38967|TAT2_YEAST Tryptophan permease OS = Saccharomyces
cerevisiae (strain ATCC 204508 / S288c) GN = TAT2 PE = 1 SV = 1
MTEDFISSVKRSNEELKERKSNFGFVEYKSKQLTSSSSHNSNSSHHDDDNQHGKRNIFQR
CVDSFKSPLDGSFDTSNLKRTLKPRHLIMIAIGGSIGTGLFVGSGKAIAEGGPLGVVIGW
AIAGSQIIGTIHGLGEITVRFPVVGAFANYGTRFLDPSISFVVSTIYVLQWFFVLPLEII
AAAMTVQYWNSSIDPVIWVAIFYAVIVSINLFGVRGFGEAEFAFSTIKAITVCGFIILCV
VLICGGGPDHEFIGAKYWHDPGCLANGFPGVLSVLVVASYSLGGIEMTCLASGETDPKGL
PSAIKQVFWRILFFFLISLTLVGFLVPYTNQNLLGGSSVDNSPFVIAIKLHHIKALPSIV
NAVILISVLSVGNSCIFASSRTLCSMAHQGLIPWWFGYIDRAGRPLVGIMANSLFGLLAF
LVKSGSMSEVFNWLMAIAGLATCIVWLSINLSHIRFRLAMKAQGKSLDELEFVSAVGIWG
SAYSALINCLILIAQFYCSLWPIGGWTSGKERAKIFFQNYLCALIMLFIFIVHKIYYKCQ
TGKWWGVKALKDIDLETDRKDIDIEIVKQEIAEKKMYLDSRPWYVRQFHFWC SEQ ID NO: 66
YOL075C
>sp|Q08234|YO075_YEAST Uncharacterized ABC transporter ATP-binding
protein/permease YOL075C OS = Saccharomyces cerevisiae (strain ATCC
204508 / S288c) GN = YOL075C PE = 1 SV = 3
MSQQENGDVATELIENRLSFSRIPRISLHVRDLSIVASKTNTTLVNTFSMDLPSGSVMAV
MGGSGSGKTTLLNVLASKISGGLTHNGSIRYVLEDTGSEPNETEPKRAHLDGQDHPIQKH
VIMAYLPQQDVLSPRLTCRETLKFAADLKLNSSERTKKLMVEQLIEELGLKDCADTLVGD
NSHRGLSGGEKRRLSIGTQMISNPSIMFLDEPTTGLDAYSAFLVIKTLKKLAKEDGRTFI
MSIHQPRSDILFLLDQVCILSKGNVVYCDKMDNTIPYFESIGYHVPQLVNPADYFIDLSS
VDSRSDKEEAATQSRLNSLIDHWHDYERTHLQLQAESYISNATEIQIQNMTTRLPFWKQV
TVLTRRNFKLNFSDYVTLISTFAEPLIIGTVCGWIYYKPDKSSIGGLRTTTACLYASTIL
QCYLYLLFDTYRLCEQDIALYDRERAEGSVTPLAFIVARKISLFLSDDFAMTMIFVSITY
FMFGLEADARKFFYQFAVVFLCQLSCSGLSMLSVAVSRDFSKASLVGNMTFTVLSMGCGF
FVNAKVMPVYVRWIKYIAFTWYSFGTLMSSTFTNSYCTTDNLDECLGNQILEVYGFPRNW
ITVPAVVLLCWSVGYFVVGAIILYLHKIDITLQNEVKSKQKKIKKKSPTGMKPEIQLLDD
VYHQKDLEAEKGKNIHITIKLEDIDLRVIFSAPFSNWKEGNFHHETKEILQSVNAIFKpG
MINAIMGPSGSGKSSLLNLISGRLKSSVFAKFDTSGSIMFNDIQVSELMFKNVCSYVSQD
DDHLLAALTVKETLKYAAALRLHHLTEAERMERTDNLIRSLGLKHCENNIIGNEFVKGIS
GGEKRRVTMGVQLLNDPPILLLDEPTSGLDSFTSATILEILEKLCREQGKTIIITIHQpR
SELFKRFGNVLLLAKSGRTAFNGSPDEMIAYFTELGYNCPSFTNVADFFLDLISVNTQNE
QNEISSRARVEKILSAWKANMDNESLSPTPISEKQQYSQESFFTEYSEFVRKPANLVLAy
IVNVKRQFTTTRRSFDSLMARIAQIPGLGVIFALFFAPVKHNTISISNRLGLAQESTALY
FVGMLGNLACYPTERDYFYEEYNDNVYGIAPFFLAYMTLELPLSALASVLYAVETVLACG
LPRTAGNFFATVYCSFIVTCCGEALGIMTNTFFERPGFVVNCISIILSIGTQMSGLMSLG
MSRVLKGFNYLNPVGYTSMIIINFAFPGNLKLTCEDGGKNSDGTCEFANGHDVLVSYGLV
RNTQKYLGIIVCVAIIYRLIAFFILKAKLEWIKW SEQ ID NO: 67
YOL077W-A
>sp|P81451|ATP19_YEAST ATP synthase subunit K, mitochondrial
OS = Saccharomyces cerevisiae (strain ATCC 204508 / S288c) GN = ATP19
PE = 1 SV = 1
MGAAYHFMGKAIPPHQLAIGTLGLLGLLVVPNPFKSAKPKTVDIKTDNKDEEKFIENYLK
KHSEKQDA SEQ ID NO: 68
YOL122C
>sp|P38925|SMF1_YEAST Manganese transporter SMF1 OS = Saccharomyces
cerevisiae (strain ATCC 204508 / S288c) GN = SMF1 PE = 1 SV = 2
MVNVGPSHAAVAVDASEARKRNISEEVFELRDKKDSTVVIEGEAPVRTFTSSSSNHERED
TYVSKRQVMRDIFAKYLKFIGPGLMVSVAYIDPGNYSTAVDAGASNQFSLLCIILLSNFI
AIFLQCLCIKLGSVTGLDLSRACREYLPRWLNWTLYFFAECAVIATDIAEVIGTAIALNI
LIKVPLPAGVAITVVDVFLIMFTYKPGASSIRFIRIFECFVAVLVVGVCICFAIELAYIP
KSTSVKQVFRGFVPSAQMFDHNGIYTAISILGATVMPHSLFLGSALVQPRLLDYDVKHGN
YTVSEEQDKVKKSKSTEEIMEEKYFNYRPTNAAIKYCMKYSMVELSITLFTLALFVNCAI
LVVAGSTLYNSPEADGADLFTIHELLSRNLAPAAGTIFMLALLLSGQSAGVVCTMSGQIV
SEGHINWKLQPWQRRLATRCISIIPCLVISICIGREALSKALNASQVVLSIVLPFLVAPL
IFFTCKKSIMKTEITVDHTEEDSHNHQNNNDRSAGSVIEQDGSSGMEIENGKDVKIVYMA
NNWIITVIAIIVWLFLSLLNVYAIVQLGMSHGDIS SEQ ID NO: 69
YOR079C
>sp|Q12067|ATX2_YEAST Metal homeostasis factor ATX2 OS = Saccharomyces
cerevisiae (strain ATCC 204508 / S288c) GN = ATX2 PE = 1 SV = 1
MKFLGVILLASELLIATFLIGLIPLYYIDKQKSSIVTNQEGADSISDFTTNADTQTINDD
VSSYRVKIAVLSQFGIGMLLGTSFMLVIPEGIKACVEHDGNVGVNLLIGFLGINVLDRLV
TLWVSRKQTVYTHDAVKFQSWKDIINHPRQIWMNLIQNNVVPALFIHGLSDGIALGTTTN
NDSLLIVVLIAIVIHKIPAVLSLTSLMVSRQNLMKWEVICNVELFASSTPIGYIVLSLLN
LSHSPTMDWISGNLLLMSGGSLLYASFTAFVGGDSHDHDLSVEQEVVLPHDESVYVLIGV
CIPLVISYCISEE TABLE 14-continued Sequences disclosed herein.

SEQ ID NO: 70
YOR087W
>sp|Q12324|YVC1_YEAST Calcium channel YVC1 OS = *Saccharomyces cerevisiae* (strain ATCC 204508 / S288c) GN = YVC1 PE = 1 SV = 2
MVSANGDLHLPISNEQCMPENNGSLGFEAPTPRQILRVTLNLKYLIDKVVPIVYDPNDIV
CDHSEILSPKVVKLAYEACGGNPKDKANKRKYQSVIIFSLLKVCEWYSILATMEVHNAKL
YETRNLASQQLCKLLIEREETRDLQFLFMQLLLRRYVINENDEDQEPLNALELATDMHCT
TVIGSSGFQRCLKWIWRGWIVQNGLDPTTFIKDDSLAEVSLISHFNPVRLKAPVYQNYLQ
MIFSFLFLGLYTLVVNGKDSERVQSFDLLESIFYVFNTGFILDELTKLYYIGYAHLSFWN
LFNDTTYLIITFAMGFRAMSVTPLNAKYSSEDWDKISYRVLSCAAPFVWSRLLLYLESQR
FIGIMLVILKHMMKESIVFFLLFLIMIGFTQGFLGLDSADGKRDITGPILGNLTITVLG
LGSFDVFEEFAPPYAAILYYGYYFIVSVILLNLIALYSTAYQKVIDNADDEYMALMSQK
TLRYIRAPDEDVYSPLNLIEVFMTPIFRILPPKRAKDLSYTVMTIVYSPFLLLISVKET
REARRIKYNRMKRLNDDANEYDTPWDLTDGYLDDDDGLFSDNRSGMRATQLKNSRSLKL
QRTAEQEDVHFKVPKKWYKNVKKCSPSFEQYDNDDTEDDAGEDKDEVKELTKKVENLTAV
ITDLLEKLDIKDKKE SEQ ID NO: 71
YOR092W
>sp|Q99252|ECM3_YEAST Protein ECM3 OS = *Saccharomyces cerevisiae* (strain ATCC 204508 / S288c) GN = ECM3 PE = 1 SV = 1
MTHITLGQAIWASVRPIIKIYLIIGVFGFGLCKMNILTVQATRSISDIVLTILLPCLSFNK
IVANIEDNDIKDVGIICLTSVILFATGLGFAFIVRSVLPVPKRWRGGILAGGMFPNISDL
PIAYLQSMDQGFIFTEAEGEKGVANVIIFLAMFLICVFNLGGFRLIENDFHYKGDDDEEN
TLTNDDSAQQPTQPIEGNSSSSSNQDILKEPNESTVPNSSQASYISEKNKKEKTELSVPK
PTHTAPPAIDDRSSNSSAVVSIDSITHSLRTNHVDAQSVSELNDPTYRTRSQPIAYTTES
RTSHVHNNRRNSITGSLRSIDMRELPAEGMSDLIREYSNVDQYGRRRKSSISSQGAPSVL
QADGTISPNLTRTSTLQRVKTSNLTRIITSDATVSKKDIETSGSSLPKWLQKFPLTKFFV
FFLKNCLRPCSMAVILALIIAFIPWVKALFVTTSNTPKIKQAPDNAPALTFIMDFTSYVG
AASVPFGLILLGATLGRLKIGKLYPGFWKSAVVLVFLRQCIMPIFGVLWCDRLVKAGWLN
WENDKMLLFVTAITWNLPTMTTLIYFTASYTPEDETEPVQMECTSFFLMLQYPLMVVSLP
FLVSYFIKVQMKL SEQ ID NO: 72
YOR130C
>sp|Q12375|ORT1_YEAST Mitochondrial ornithine transporter 1 OS = *Saccharomyces cerevisiae* (strain ATCC 204508 / S288c) GN = ORT1 PE = 1 SV = 2
MEDSKKKGLIEGAILDIINGSIAGACGKVIEFPFDTVKVRLQTQASNVFPTTWSCIKFTY
QNEGIARGFFQGIASPLVGACLENATLFVSYNQCSKFLEKHINVSPLGQILISGGVAGSC
ASLVLTPVELVKCKLQVANLQVASAKTKHTKVLPTIKAIITERGLAGLWQGQSGTFIRES
FGGVAWFATYEIVKKSLKDRHSLDDPKRDESKIWELLISGGSAGLAFNASIFPADTVKSV
MQTEHISLTNAVKKIFGKFGLKGFYRGLGITLFRAVPANAAVFYIFETLSAL SEQ ID NO: 73
YOR222W
>sp|Q99297|ODC2_YEAST Mitochondrial 2-oxodicarboxylate carrier 2 OS = *Saccharomyces cerevisiae* (strain ATCC 204508 / S288c) GN = ODC2 PE = 1 SV = 1
MSSDSNAKPLPFIYQFISGAVAGISELTVMYPLDVVKTRFQLEVTTPTAAAVGKQVERYN
GVIDCLKKIVKKEGFSRLYRGISSPMLMEAPKRATKFACNDQYQKIFKNLFNTNETTQKI
SIAAGASAGMTEAAVIVPFELIKIRMQDVKSSYLGPMDCLKKTIKNEGIMGLYKGIESTM
WRNALWNGGYFGVIYQVRNSMPVAKTKGQKTRNDLIAGAIGGTVGTMLNTPFDVVKSRIQ
SVDAVSSAVKKYNWCLPSLLVIYREEGFRALYKGFVPKVCRLAPGGSLMLVVFTGMMNFF
RDLKYGH SEQ ID NO: 74
YOR291W
>sp|Q12697|YPK9_YEAST Vacuolar cation-transporting ATPase YPK9 OS = *Saccharomyces cerevisiae* (strain ATCC 204508 / S288c) GN = YPK9 PE = 1 SV = 1
MDIPSSNQIQHGQRSERNRRMPRASFSSTATTSTAATLTSAMVLDQNNSEPYAGATFEAV
PSSIVSFHHPHSFQSSNLPSPHSSGNLEQRGRRLTESEPLVLSSAEQSRSSSRNPSHFRF
FTQEQISNAEGASTLENTDYDMAWDATPAYEQDRIYGTGLSSRRSSIRFSRASSLSNAK
SYGSFSKRGRSGSRAPQRLGENSDTGFVYHSATHSSSSLSRYTTRERIPIELESQTDEIL
EDESSTHSLESSDSRRSASENNRGSFSGHDDVHNQHSEYLKPDYHEKFYPQYAPNLHYQR
FYIAEEDLVIGIAAYQTSKFWYIIYNLCCFLTFGLVYLLTRWLPHLKVKLYGVKVPLAKA
EWVVIENEFGEFVIQPIDRQWYNRPLSTVLPFENYPNPSYEPNDINLSHHHANEINPNVP
ILITFEYRYIKFIYSPLDDLFKTNNNWIDPDWVDLSTVSNGLTKVGVQEDRELAFGKNQIN
LRMKTTSEILFNEVLHPFYVFQVFSIILWGIDEYYYYAACIFLISVLSIFDSLNEQKKVS
RNLAEMSHFHCDVRVLRDKFWTTISSSELVPGDIYEVSDPNITILPCDSILLSSDCIVNE
SMLTGESVPVSKFPATEETMYQLCDDFQSTQISSFVSKSFLYNGTNIIRARIAPGQTAAL
AMVVRTGFSTTKGSLVRSMVFPKPTGFKFYRDSFKYIGFMSLIAIFGFCVSCVQFIKLGL
DKKTMILRALDIITIVVPPALPATLTIGTNFALSRLKEKGIFCISPTRLNISGKIDVMCF
DKTGTLTEDGLDVLGVQISEPNGVRGQKFGELLSDIRQVFPKFSLNDCSSPLDFKSRNFF
MSLLTCHSLRSVDGNLLGDPLDFKMFQFTGWSFEEDFQKRAFHSLYEGRHEDDVFPENSE
IIPAVVHPDSNNRENTFTDNDPHNFLGVVRSFEFLSELRRMSVIVKTNNDDVYWSFTKGA
PEVISEICNKSTLPADFEEVLRCYTHNGYRVIACAGKTLPKRTWLYSQKVSREEVESNLE TABLE 14-continued Sequences disclosed herein.

FLGFIIFQNKLKKETSETLKSLQDANIRTIMCTGDNILTAISVGREAGLIQCSRVYVPSI
NDTPLHGEPVIVWRDVNEPDKILDTKTLKPVKLGNNSVESLRECNYTLAVSGDVFRLLFR
DENEIPEEYLNEILLNSSIYARMSPDEKHELMIQLQKLDYTVGFCGDGANDCGALKAADV
GISLSEAEASVAAPFTSKIFNISCVLDVIREGRAALVISFACFQYMSLYSAIQFITITIL
YSRGSNLGDFQFLYIDLLLIVPIAICMSWSKSYEKIDKKRPSANLVSPKILVPLLISVFL
VFLFQFIPWIIVQKMSWYIKPIVGGDDAVQSSDNTVLFFVSNFQYILTAIVLSVGPPYRE
PMSKNFEFIVDITVSIGASLLLMTLDTESYLGKMLQLTPISNSFTMFIIVWVILNYYAQL
YIPPSIKGWLKKKKSSKKYKLLIQEEMKLKEV

SEQ ID NO: 75
YOR306C
>sp|Q08777|MCH5_YEAST Riboflavin transporter MCH5 OS = Saccharomyces
cerevisiae (strain ATCC 204508 / S288c) GN = MCH5 PE = 1 SV = 2
MSSDSLTPKDTIVPEEQTNQLRQPDLDEDSIHYDPEADDLESLETTASYASTSVSAKVYT
KKEVNKGTDIESQPHWGENTSSTHDSDKEEDSNEEIESFPEGGFKAWVVTFGCFLGLIAC
FGLLNSTGVIESHLQDNQLSSESVSTIGWLFSLFLFVCSASCIISGTYFDRNGFRTIMIV
GTVFHVAGLFATANSTKYWHFILSFAIVCGFGNGIVLSPLVSVPAHYFFKRRGTALAMAT
IGGSVGGVVFPIMLRSFFSMKSDTDPTYGFVWGIRTLGFLDLALLTLSIILVKERLPHVI
ENSKDGESRWRYILRVYILQCFDAKAFLDMKYLFCVLGTVFSELSINSALTYYGSYATSH
GISANDAYTLIMIINVCGIPGRWVPGYLSDKFGRFNVAIATLLTLFIVMFVGWLPFGTNL
TNMYVISALYGFCSGSVFSLLPVCCGQISKTEEFGKRYSTMYFVVGFGTLVGIPITGAII
SIKTTADYQHYIIFCGLATFVSAVCYIISRAYCVGFKWVRF SEQ ID NO: 76
YOR316C
>sp|P32798|COT1_YEAST Cobalt uptake protein COT1 OS = Saccharomyces
cerevisiae (strain ATCC 204508 / S288c) GN = COT1 PE = 1 SV = 2
MKLGSKQVKIISLLLLDTVFFGIEITTGYLSHSLALIADSFHMLNDIISLVVALWAVNVA
KNRNPDSTYTYGWKRAEILGALINAVFLIALCVSILIEALQRIIAPPVIENPKFVLYVGV
AGLISNTVGLFLFHDNDQEHGHGHGHSHGGIFADHEMHMPSSHTHTHAHVDGIENTTPMD
STDNISEIMPNAIVDSFMNENTRLLTPENASKTPSYSTSSHTIASGGNYTEHNKRKRSLN
MHGVFLHVLGDALGNIGVMLSAFFIWKTDYSWKYYTDPLVSLIITGIIFSSALPLSCKAS
KILLQATPSTLSGDQVEGDLLKIPGIIAIHDFHIWNLTESIFIASLHIQLDISPEQFTDL
AKIVRSKLHRYGIHSATLQPEFITREVTSTERAGDSQGDHLQNDPLSLRPKTYGTGISGS
TCLIDDAANCNTADCLEDH SEQ ID NO: 77
YOR334W
>sp|Q01926|MRS2_YEAST Magnesium transporter MRS2, mitochondrial
OS = Saccharomyces cerevisiae (strain ATCC 204508 / S288c) GN = MRS2
PE = 1 SV = 2
MNRRLLVRSISCFQPLSRITFGRPNTPFLRKYADTSTAANTNSTILRKQLLSLKPISASD
SLFISCTVFNSKGNIISMSEKFPKWSFLTEHSLFPRDLRKIDNSSIDIIPTIMCKPNCIV
INLLHIKALIERDKVYVFDTTNPSAAAKLSVLMYDLESKLSSTKNNSQFYEHRALESIFI
NVMSALETDFKLHSQICIQILNDLENEVNRLKLRHLLIKSKDLTLFYQKTLLIRDLLDEL
LENDDDLANMYLTVKKSPKDNFSDLEMLIETYYTQCDEYVQQSESLIQDIKSTEEIVNII
LDANRNSLMLLELKVTIYTLGFTVASVLPAFYGMNLKNFIEESEWGFTSVAVFSIVSALY
ITKKNFNSLRSVTKMTMYPNSPANSSVYPKTSASIALTNKLKRRRKWWKSTKQRLGVLLY
GSSYTNKANLSNNKINKGFSKVKKFNMENDIKNKQNRDMIWKWLIEDKKN SEQ ID NO: 78
YPL078C
>sp|P05626|ATPF_YEAST ATP synthase subunit 4, mitochondrial
OS = Saccharomyces cerevisiae (strain ATCC 204508 S288c) GN = ATP4
PE = 1 SV = 2
MSMSMGVRGLALRSVSKTLFSQGVRCPSMVIGARYMSSTPEKQTDPKAKANSIINAIPGN
NILTKTGVLGTSAAAVIYAISNELYVINDESILLLTFLGFTGLVAKYLAPAYKDFADARM
KKVSDVLNASRNKHVEAVKDRIDSVSQLQNVAETTKVLFDVSKETVELESEAFELKQKVE
LAHEAKAVLDSWVRYEASLRQLEQRQLAKSVISRVQSELGNPKFQEKVLQQSISEIEQLL
SKLK SEQ ID NO: 79
YPL270W
>sp|P33311|MDL2_YEAST ATP-dependent permease MDL2, mitochondrial
OS = Saccharomyces cerevisiae (strain ATCC 204508 / S288c) GN = MDL2
PE = 1 SV = 3
MLNGRLPLLRLGICRNMLSRPRLAKLPSIRFRSLVTPSSSQLIPLSRLCLRSPAVGKSLI
LQSFRCNSSKTVPETSLPSASPISKGSARSAHAKEQSKTDDYKDIIRLFMLAKRDWKLLL
TAILLLTISCSIGMSIPKVIGIVLDTLKTSSGSDFFDLKIPIFSLPLYEFLSFFTVALLI
GCAANFGRFILLRILSERVVARLRANVIKKTLHQDAEFFDNHKVGDLLISRLGSDAYVSR
SMTQKVSDGVKALICGVVGVGMMCSLSPQLSILLLFFTPEWLFSASVFGKQIRNTSKDLQ
EATGQLTRVAEEQLSGIKTVQSFVAEGNELSRYNVAIRDIFQVGKTAAFTNAKFFTTTSL
LGDLSFLTVLAYGSYLVLQSQLSIGDLTAFMLYTEYTGNAVFGLSTFYSEIMQGAGAASR
LFELTDRKPSISPTVGHKYKPDRGVIEFKDVSFSYPTRPSVQIFKNLNFKIAPGSSVCIV
GPSGRGKSTIALLLLRYYNPTTGTITIDNQDISKLNCKSLRRHIGIVQQEPVLMSGTIRD
NITYGLTYTPTKEEIRSVAKQCFCHNFITKFPNTYDTVIGPHGTLLSGGQKQRIAIARAL TABLE 14-continued Sequences disclosed herein.

```
IKKPTILILDEATSALDVESEGAINYTFGQLMKSKSMTIVSIAHRLSTIRRSENVIVLGH
DGSVVEMGKFKELYANPTSALSQLLNEKAAPGPSDQQLQIEKVIEKEDLNESKEHDDQKK
DDNDDNDNNHDNDSNNQSPETKONNSDDIEKSVEHLLKDAAKEANPIKITPQP

SEQ ID NO: 80
YPL274W
>sp|Q08986|SAM3_YEAST S-adenosylmethionine permease SAM3
OS = Saccharomyces cerevisiae (strain ATCC 204508 / S288c) GN = SAM3
PE = 1 SV = 1
MDILKRGNESDKFTKIETESTTIPNDSDRSGSLIRRMKDSFKQSNLHVIPEDLENSEQTE
QEKIQWKLASQPYQKVLSQRHLTMIAIGGTLGTGLFIGLGYSLASGPAALLIGFLLVGTS
MFCVVQSAAELSCQFPVSGSYATHVSRFIDESVGFTVATNYALAWLISFPSELIGCALTI
SYWNQTVNPAVWVAIFYVFIMVLNLFGVRGFAETEFALSIIKVIAIFIFIIIGIVLIAGG
GPNSTGYIGAKYWHDPGAFAKPVFKNLCNTFVSAAFSFGGSELVLLTSTESKNISAISRA
AKGTFWRIAIFYITTVVIIGCLVPYNDPRLLSGSNSEDVSASPFVIALSNTGSMGAKVSN
FMNVVILVAVVSVCNSCVYASSRLIQALGASGQLPSVCSYMDRKGRPLVGIGISGAFGLL
GFLVASKKEDEVFTWLFALCSISSFFTWFCICMSQIRFRMALKAQGRSNDEIAYKSILGV
YGGILGCVLNALLIAGEIYVSAAPVGSPSSAEAFFEYCLSIPIMIVVYFAHRFYRRDWKH
FYIKRSEIDLDTGCSVENLELFKAQKEAEEQLIASKPFYYKIYRFWC SEQ ID NO: 81
YPR003C
>sp|P53394|SULX_YEAST Putative sulfate transporter YPR003C
OS = Saccharomyces cerevisiae (strain ATCC 204508 / S288c) GN = YPR003C
PE = 1 SV = 1
MTSNNSLLGRGRMSYSSTAPPRFKRSVDQRDTFSDNFDYDKDSSNRGRTYIAASNSTTGV
PPPNNSRSGCTNNTNNTNNTSNTSNTNNNDSVDENTVFETLPYYLPCFSWLPEYTFNKLW
GDVIAGISVASFQIPLALSYTTSIAHVPPLCGLYSLAISPFVYGILGSVPQMIVGPESAI
SLVVGQAVESITLHKENVSLIDISTVITFVSGTILLFSGISRFGFLGNVLSKALLRGFIS
SVGLVMIINSLISELKLDKFLVSLPQHYHTPFEKILFLIDYAPAQYHIPTAIFSGCCLIV
LFLTRLLKRKLMKYHKSAIFFPDILLVVIVTILISMKFNLKHRYGISIIGDFSMDNFDEL
KNPLTRPRRKLIPDLFSASLIVAMLGFFESTTASKSLGTTYNLTVSSNRELVALGFMNIV
ISLFGALPAFGGYGRSKINALSGAQSVMSGVFMGVITLITMNLLLQFVHYIPNCVLSVIT
TIIGISLLEEVPGDIKFHLRCGGFSELFVFAVTFCTTIFYSIEAGICIGCNNSIINIIKH
SAKSRIQILARVAGTSNFTNLDDYMMNMKRNSLDVEGTEEIEGCMIVRIPEPLTFTNSED
LKQRLDRIERYGSSKIHPGRKSLRSKDSIKYVIFDLGGMTSIDSSAAQVLEEIITSYKRR
NVFIYLVNVSINDKVRRRLFKAGVAASVERAQANNNENNTSNTFSDAGETYSPYTDSIDA
ALYEIEKMKIKGNNVPNNDSESFMSNTLFNSSLV SEQ ID NO: 82
YPR011C
>sp|Q12251|YP011_YEAST Uncharacterized mitochondrial carrier YPR011C
OS = Saccharomyces cerevisiae (strain ATCC 204508 / S288c) GN = YPR011C
PE = 1 SV = 1
MAEVLTVLEQPNSIKDFLKQDSNIAFLAGGVAGAVSRTVVSPFERVKILLQVQSSTTSYN
RGIFSSIRQVYHEEGTKGLFRGNGLNCIRIFPYSAVQFVVYEACKKKLFHVNGNNGQEQL
TNTQRLFSGALCGGCSVVATYPLDLIKTRLSIQTANLSSLNRSKAKSISKPPGIWQLLSE
TYRLEGGLRGLYRGVWPTSLGVVPYVALNFAVYEQLREFGVNSSDAQPSWKSNLYKLTIG
AISGGVAQTITYPFDLLRRRFQVLAMGGNELGFRYTSVWDALVTIGRAEGVSGYYKGLAA
NLFKVVPSTAVSWLVYEVVCDSVRNW SEQ ID NO: 83
YPR058W
>sp|P32331|YMC1_YEAST Carrier protein YMC1, mitochondrial
OS = Saccharomyces cerevisiae (strain ATCC 204508 / S288c) GN = YMC1
PE = 1 SV = 2
MSEEFPSPQLIDDLEEHPQHDNARVVKDLLAGTAGGIAQVLVGQPFDTTKVRLQTSSTPT
TAMEVVRKLLANEGPRGFYKGTLTPLIGVGACVSLQFGVNEAMKRFFHHRNADMSSTLSL
PQYYACGVTGGIVNSFLASPIEHVRIRLQTQTGSGTNAEFKGPLECIKKLRHNKALLRGL
TPTILREGHGCGTYFLVYEALIANQMNKRRGLERKDIPAWKLCIFGALSGTALWLMVYPL
DVIKSVMQTDNLQKPKFGNSISSVAKTLYANGGIGAFFKGFGPTMLRAAPANGATFATFE
LAMRLLG SEQ ID NO: 84
YPR128C
>sp|Q06497|ANT1_YEAST Peroxisomal adenine nucleotide transporter 1
OS = Saccharomyces cerevisiae (strain ATCC 204508 / S288c) GN = ANT1
PE = 1 SV = 1
MLTLESALTGAVASAMANIAVYPLDLSKTIIQSQVSPSSSEDSNEGKVLPNRRYKNVVDC
MINIFKEKGILGLYQGMTVTTVATFVQNFVYFFWYTFIRKSYMKHKLLGLQSLKNRDGPI
TPSTIEELVLGVAAASISQLFTSPMAVVATRQQTVHSAESAKFTNVIKDIYRENNGDITA
FWKGLRTGLALTINPSITYASFQRLKEVFFHDHSNDAGSLSAVQNFILGVLSKMISTLVT
QPLIVAKAMLQSAGSKFTTFQEALLYLYKNEGLKSLWKGVLPQLTKGVIVQGLLFAFRGE
LTKSLKRLIFLYSSFFLKHNGQRKLAST
```

TABLE 14-continued

Sequences disclosed herein.

SEQ ID NO: 85
YPR201W
>sp|Q06598|ARR3_YEAST Arsenical-resistance protein 3
OS = Saccharomyces cerevisiae (strain ATCC 204508 / S288c) GN = ARR3
PE = 1 SV = 1
MSEDQKSENSVPSKVNMVNRTDILTTIKSLSWLDLMLPFTIILSIIIAVIISVYVPSSRH
TFDAEGHPNLMGVSIPLTVGMIVMMIPPICKVSWESIHKYFYRSYIRKQLALSLFLNWVI
GPLLMTALAWMALFDYKEYRQGIIMIGVARCIAMVLIWNQIAGGDNDLCVVLVITNSLLQ
MVLYAPLQIFYCYVISHDHLNTSNRVLFEEVAKSVGVFLGIPLGIGIIIRLGSLTIAGKS
NYEKYILRFISPWAMIGFHYTLFVIFISRGYQFIHEIGSAILCFVPLVLYFFIAWFLTFA
LMRYLSISRSDTQRECSCDQELLLKRVWGRKSCEASFSITMTQCFTMASNNFELSLAIAI
SLYGNNSKQAIAATFGPLLEVPILLILAIVARILKPYYIWNNRN SEQ ID NO: 86
YBR008C
>sp|P38124|FLR1_YEAST Fluconazole resistance protein 1
OS = Saccharomyces cerevisiae (strain ATCC 204508 / S288c) GN-FLR1
PE = 1 SV = 1
MVYTSTYRHTIVVDLLEYLGIVSNLETLQSAREDETRKPENTDKKECKPDYDIECGPNRS
CSESSTDSDSSGSQIEKNDPFRVDWNGPSDPENPQNWPLLKKSLVVFQIMLLTCVTYMGS
SIYTPGQEYIQEEFHVGHVVATLNLSLYVLGYGLGPIIFSPLSETARYGRLNLYMVTLFF
FMIFQVGCATVHNIGGLIVMRFISGILCSPSLATGGGTVADIISPEMVPLVLGMWSAGAV
AAPVLAPLLGAAMVDAKNWRFIFWLLMWLSAATFILLAFFFPETQHHNILYRRALKLRKE
TGDDRYYTEQDKLDREVDARTFLINTLYRPLKMIIKEPAILAFDLYIAVAYGCFYLFFEA
FPIVFVGIYHFSLVEVGLAYMGFCVGCVLAYGLFGILNMRIIVPRFRNGTFTPEAFLIVA
MCVCWCLPLSLFLFGWTARVHWILPVISEVFFVLAVFNIFQATFAYLATCYPKYVASVFA
GNGFCRASFACAFPLFGRAMYDNLATKNYPVAWGSSLVGFLTLGLAIIPFILYKYGPSLR
TRSSYTEE SEQ ID NO: 87
YBR021W
>sp|P05316|FUR4_YEAST Uracil permease OS = Saccharomyces cerevisiae
(strain ATCC 204508 / S288c) GN = FUR4 PE = 3 SV = 2
MPDNLSLHLSGSSKRLNSRQLMESSNETFAPNNVDLEKEYKSSQSNITTEVYEASSFEEK
VSSEKPQYSSFWKKIYYEYVVVDKSILGVSILDSFMYNQDLKPVEKERRVWSWYNYCYFW
LAECFNINTWQIAATGLQLGLNWWQCWITIWIGYGFVGAFVVLASRVGSAYHLSFPISSR
ASFGIFFSLWPVINRVVMAIVWYSVQAYIAATPVSLMLKSIFGKDLQDKIPDHFGSPNAT
TYEFMCFFIFWAASLPFLLVPPHKIRHLFTVKAVLVPFASFGFLIWAIRRAHGRIALGSL
TDVQPHGSAFSWAFLRSLMGCMANFSTMVINAPDFSRFSKNPNSALWSQLVCIPFLFSIT
CLIGILVTAAGYEIYGINYWSPLDVLEKFLQTTYNKGTRAGVFLISFVFAVAQLGTNISA
NSLSCGTDMSAIFPKFINIKRGSLFCAAMALCICPWNLMATSSKFTMALSAYAIFLSSIA
GVVCSDYFVVRRGYIKLTHIYSHQKGSFYMYGNRFGINWRALAAYLCGVAPCLPGFIAEV
GAPAIKVSDGAMKLYYLSYWVGYGLSFSSYTALCYFFPVPGCPVNNIIKDKGWFQRWANV
DDFEEEWKDTIERDDLVDDNISVYEHEHEKTFI SEQ ID NO: 88
YBR043C
>sp|P38227|QDR3_YEAST Quinidine resistance protein 3
OS = Saccharomyces cerevisiae (strain ATCC 204508 / S288c) GN = QDR3
PE = 1 SV = 2
MQAQGSQSNVGSLRSNCSDNSLPNNHVMMHCDESSGSPHSEHNDYSYEKTNLESTASNSR
EHRDNQLSRLKSEEYVVPKNQRRGLLPQLAIIPEFKDARDYPPMMKKMIVFLIAFSSMMG
PMGTSIIFPAINSITTEFKTSVIMVNVSIGVYLLSLGVFPLWWSSLELEGRRTTYITSF
ALLFAFNIGSALAPDINSFIALRMLCGAASASVQSVGAGTVADLYISEDRGKNLSYYYLG
PLLAPLLSPIFGSLLVNRWPWRSTQWFMVILSGCNVILLTVLLPETLRKQDSKGAIAQIL
AERRIQVDNNERGEIQEDYQRGEDETDRIENQVATLSTEKHNYVGEVRDQDSLDLESHSS
PNTYDGRAGETQLQRIYTEASRSLYEYQLDDSGIDATTAQVTRIRSTDPKLARSIRENSL
RKLQTNLEEQVKKVLSSNGGEIAPKQVSAVRKVWDTFFVYFIKPLKSLHFLEYPPVALAI
TFSAISFSTVYFVNMTVEYKYSRPPYNFKPLYIGLLYIPNSVTYFFASIYGGRWVDMLLK
RYKEKYGILAPEARISWNVVTSVISFPIALLIFGWCLDKKCHWVTPLIGTALFGYAAMMT
IGATLSYLVDSLPGKGATGVALNNLIRQILAATAVFVTTPMLNGMGTGWAFTMLAFIVLG
ASSVLIILKKHGDYWRENYDLQKLYDKID SEQ ID NO: 89
YBR287W
>sp|P38355|YB8B_YEAST Uncharacterized transporter YBR287W
OS = Saccharomyces cerevisiae (strain ATCC 204508 / S288c) GN = YBR287W
PE = 1 SV = 1
MVETFSFAHLAYLVFESVLQVVIIALAGFWSASSGLLPKQSQKIISLLNVDLFTPCLIFS
KLAKSLSMAKIFEIAIIPIFFGLTTGISFISGKIMSRILDLDKDETNFVVANSVFGNSNS
LPVSLTLSLAYTLPNLTWDQIPNDNRDNVASRGILYLLIFQQIGQMLRWSWGYNKLMKWS
GENTQHMPPSQVQSLLERTPNIDNEELVNEEQEEQELLEEENNRMNSSFLSSSSIGDKIW
QKSCTVFERIRANLNPPLYSMIFAVVVAAIGPLQRELFMEDGFINNTFAEAVTQLGSVSI
PLILVVLGSNLYPSAEVFPKTVHHSKLLIGSIIGRMILPSCFLLPIIAIAVKYINVSILD
DPIFLVVGFLLTVSPPAIQLTQITQLNEFFEAEMADILFWGYAVLSLPVSIIVVSGAIYV
LQWANPT TABLE 14-continued Sequences disclosed herein.

SEQ ID NO: 90
YBR295W
>sp|P38360|ATU1_YEAST P-type cation-transporting ATPase
OS = Saccharomyces cerevisiae (strain ATCC 204508 / S288c) GN = PCA1
PE = 1 SV = 2
MKPEKLFSGLGTSDGEYGVVNSENISIDAMQDNRGECHRRSIEMHANDNLGLVSQRDCTN
RPKITPQECLSETEQICHHGENRTKAGLDVDDAETGGDHTNESRVDECCAEKVNDTETGL
DVDSCCGDAQTGGDHTNESCVDGCCVRDSSVMVEEVTGSCEAVSSKEQLLTSFEVVPSKS
EGLQSIHDIRETTRCNTNSNQHTGKGRLCIESSDSTLKKRSCKVSRQKIEVSSKPECCNI
SCVERIASRSCEKRTFKGSTNVGISGSSSTDSLSEKFFSEQYSRMYNRYSSILKNLGCIC
NYLRTLGKESCCLPKVRFCSGEGASKKTKYSYRNSSGCLTKKKTHGDKERLSNDNGHADF
VCSKSCCTKMKDCAVTSTISGHSSSEISRIVSMEPIENHLNLEAGSTGTEHIVLSVSGMS
CTGCESKLKKSFGALKCVHGLKTSLILSQAEFNLDLAQGSVKDVIKHLSKTTEFKYEQIS
NHGSTIDVVVPYAAKDFINEEWPQGVTELKIVERNIIRIYFDPKVIGARDLVNEGWSVPV
SIAPFSCHPTIEVGRKHLVRVGCTTALSIILTIPILVMAWAPQLREKISTISASMVLATI
IQFVIAGPFYLNALKSLIFSRLIEMDLLIVLSTSAAYIFSIVSFGYFVVGRPLSTEQFFE
TSSLLVTLIMVGRFVSELARHRAVKSISVRSLQASSAILVDKTGKETEINIRLLQYGDIF
KVLPDSRIPTDGTVISGSSEVDEALITGESMPVPKKCQSIVVAGSVNGTGTLFVKLSKLP
GNNTISTIATMVDEAKLTKPKIQNIADKIASYFVPTIIGITVVTFCVWIAVGIRVEKQSR
SDAVIQAIIYAITVLIVSCPCVIGLAVPIVFVIASGVAAKRGVIFKSAESIEVAHNTSHV
VFDKTGTLTEGKLTVVHETVRGDRHNSQSLLLGLTEGIKHPVSMAIASYLKEKGVSAQNV
SNTKAVTGKRVEGTSYSGLKLQGGNCRWLGHNNDPDVRKALEQGYSVFCFSVNGSVTAVy
ALEDSLRADAVSTINLLRQRGISLHILSGDDDGAVRSMAARLGIESSNIRSHATPAEKSE
YIKDIVEGRNCDSSSQSKRPVVVFCGDGTNDAIGLTQATIGVHINEGSEVAKLAADVVML
KPKLNNILTMITVSQKAMFRVKLNFLWSFTYNLFAILLAAGAFVDFHIPPEYAGLGELVS
ILPVIFVAILLRYAKI SEQ ID NO: 91
YBR296C
>sp|P38361|PHO89_YEAST Phosphate permease PHO89 OS = Saccharomyces
cerevisiae (strain ATCC 204508 / S288c) GN = PHO89 PE = 1 SV = 1
MALHQFDYIFAIAMLFAFLDAFNIGANDVANSFASSISSRSLKYWQAMVLAGLCEFLGAV
LAGARVSGTIKNNIIDSSIFTNDPAVLMLTMTSALIGSSCWLTFATAIGMPVSTTHSIVG
GTIGAGIAAGGANGVVWGWSGVSQIIASWFIAPILAGAIAAIVFSISRFSVLEVKSLERS
IKNALLLVGVLVFATFSILTMLIVWKGSPNLHLDDLSETETAVSIVLTGAIASIVYPIFF
YPFYRRKVLDQDWTLKLIDIFRGPSFYFKSTDDIPPMPEGHQLTIDYYEGRRNLGTTVSV
EDEENKAASNSNDSVKNKEDIQEVDLVRTETEPETKLSTKQYWWSLLKQGPKKWPLLFWL
VISHGWTQDVIHAQVNDRDMLSGDLKGMYERSKFYDNRVEYIYSVLQAITAATMSFAHGA
NDVANATGPLSAVYVIWKTNTIGAKSEVPVWVLAYGGVALVIGCWTYGYNIIKNLGNKMI
LQSPSRGFSIELAVAITTVMATQLGIPTSTTQIAVGGIVAVGLCNKDLKSVNWRMVAWCY
SGWFLTLPIAGLIAGIINGIILNAPRFGVEYQMT SEQ ID NO: 92
YCL038C
>sp|P25568|ATG22_YEAST Autophagy-related protein 22 OS = Saccharomyces
cerevisiae (strain ATCC 204508 / S288c) GN = ATG22 PE = 1 SV = 1
MSYGTINDMNESVTNYRIKKAQNNIKGWYAYSFSSEPFVVSAVSTYIPLLLQQFASINGV
KVHDHSIPCLSETGSDSDKCVLGLFNNRIFVDTSSFALYVFSLSVLFQTIIVISVSGIVD
LWGSVKFKGRILVWFGIVGALSTVAISKLNDTQIYSLAGLYIVANGCFGVINVVGNSLLP
IFVKDSLKCQSQGAYEPDKVDSLTTVISGRGASLGYSSALIVQIVSMFLVASKKGSKQDV
QVAVLFVGIWWFVWQLPMIWLIDDVTIPIRVDDSTLASARSPYPGEQDALGQLNWKNYLS
YGWVSLFESFKHARLLKDVMIFLIAWFIISDSITTINSTAVLFSKAELHMSTLNLIMISV
LIVVNAMLGAFM1PQFLATKFRWTSSQTLMYIIIWASFIPFYGILGFFFNAFGLKHKFEM
FLLAIWYGLSLGGLSAVSRSVFSLIVPPGKESTFFSMFSITDKGSSILGPFLVGLLTDKT
HNIRYSFYFFFLLLMLSLPVLNCLDVKRGRREAEELSQVLPESERRLD SEQ ID NO: 93
YCR011C
>sp|P25371|ADP1_YEAST Probable ATP-dependent permease
OS = Saccharomyces cerevisiae (strain ATCC 204508 / S288c) GN = ADP1
PE = 1 SV = 2
MGSHRRYLYYSILSFLLLSCSVVLAKQDKTPFFEGTSSKNSRLTAQDKGNDTCPPCFNCM
LPIFECKQFSECNSYTGRCECIEGFAGDDCSLPLCGGLSPDESGNKDRPIRAQNDTCHCD
NGWGGINCDVCQEDFVCDAFMPDPSIKGTCYKNGMIVDKVFSGCNVTNEKILQILNGKIP
QITFACDKPNQECNFQPFWIDQLESFYCGLSDCAFEYDLEQNTSHYKCNDVQCKCVPDTVL
CGAKGSIDISDFLTETIKGPGDFSCDLETRQCKFSEPSMNDLILTVFGDPYITLKCESGE
CVHYSEIPGYKSPSKDPTVSWQGKLVLALTAVMVLALFTFATFYISKSPLFRNGLGSSKS
PIRLPDEDAVNNFLQNEDDTLATLSFENITYSVPSINSDGVEETVLNEISGIVKPGQILA
IMGGSGAGKTTLLDILAMKRKTGHVSGSIKVNGISMDRKSFSKIIGFVDQDDFLLPTLTV
FETVLNSALLRLPKALSFEAKKARVYKVLEELRIIDIKDRIIGNEFDRGISGGEKRRVSI
ACELVTSPLVLFLDEPTSGLDASNANNVIECLVRLSSDYNRTLVLSIHQPRSNIFYLFDK
LVLLSKGEMVYSGNAKKVSEFLRNEGYICPDNYNIADYLIDITFEAGPQGKRRRIRNISD
LEAGTDTNDIDNTIHQTTFTSSDGTTQREWAHLAAHRDEIRSLLRDEEDVEGTDGRAGAT
EIDLNTKLLHDKYKDSVYYAELSQEIEEVLSEGDEESNVLNGDLPTGQQSAGFLQQLSIL
NSRSFKNMYRNPKLLLGNYLLTILLSLFLGTLYYNVSNDISGFQNRMGLFFFILTYFGFV
TFTGLSSFALERIIFIKERSNNYYSPLAYYISKIMSEVVPLRVVPPILLSLIVYPMTGLN TABLE 14-continued Sequences disclosed herein.

```
MKDNAFFKCIGILILFNLGISLEILTIGIIFEDLNNSIILSVLVLLGSLLFSGLFINTKN
ITNVAFKYLKNFSVFYYAYESLLINEVKTLMLKERKYGLNIEVPGATILSTFGFVVQNLV
FDIKILALFNVVFLIMGYLALKWIVVEQK

SEQ ID NO: 94
YDL054C
>sp|Q07376|MCH1_YEAST Probable transporter MCH1 OS = Saccharomyces
cerevisiae (strain ATCC 204508 / S288c) GN = MCH1 PE = 1 SV = 1
MPLSKVEHYLSYHTRLLLPHVLSLQSSHRVAYIFSLLSAVSTGFITLISLYSQPWQKHLN
YSSWQINTIASMTNLGMYLTPPILGMIADSHGPITLSLLAIIGFIPSYSYLAYVFNHPEL
SLGGNGDSSFNLSIICFVFIGISTSALYFSALLTCTKLYPHTKLLSISLPITCYGISSVV
GSQLLRIKWFWSSNASSSSSNSDLNLGRVFQTFALVYVVIGLLAWIATSVVSLLHFNEEQ
DNQKRLDDQTDVEQSPLLERSNHVQEKFTQTMLRIFSDPVIYILAVSILLSLGPLEMFIA
NMGSLINLLVQLDAPTLSTKLLSTYALSSTFTRLLTGIVADFFAKKKISIKWILLTFLSL
GVCAQLFLLKMTSSASPWGLVPTGSLVGIVYGGLFTVYPTLVLLVWGERSFGTVYGSLLI
APAIGSMIFCMLYAKFYDSRCMSGGGDLRNPSCISAVYKYSSIAFVVSAVLSAVVFWKLK
SRKLRI SEQ ID NO: 95
YDL100C
>sp|Q12154|GET3_YEAST ATPase GET3 OS = Saccharomyces cerevisiae
(strain ATCC 204508 / S288c) GN = GET3 PE = 1 SV = 1
MDLTVEPNLHSLITSTTHKWIFVGGKGGVGKTTSSCSIAIQMALSQPNKQFLLISTDPAH
NLSDAFGEKFGKDARKVTGMNNLSCMEIDPSAALKDMNDMAVSRANNNGSDGQGDDLGSL
LQGGALADLTGSIPGIDEALSFMEVMKHIKRQEQGEGETFDTVIFDTAPTGHTLRFLQLP
NTLSKLLEKFGEITNKLGPMLNSFMGAGNVDISGKLNELKANVETIRQQFTDPDLTTFVC
VCISEFLSLYETERLIQELISYDMDVNSIIVNQLLFAENDQEHNCKRCQARWKMQKKYLD
QIDELYEDFHVVKMPLCAGEIRGLNNLTKFSQFLNKEYNPITDGKVIYELEDKE SEQ ID NO: 96
YDL245C
>sp|P54854|HXT15_YEAST Hexose transporter HXT15 OS = Saccharomyces
cerevisiae (strain ATCC 204508 / S288c) GN = HXT15 PE = 1 SV = 1
MASEQSSPEINADNLNSSAADVHVQPPGEKEWSDGFYDKEVINGNTPDAPKRGFLGYLII
YLLCYPVSFGGFLPGWDSGITAGFINMDNFKMNFGSYKHSTGEYYLSNVRMGLLVAMFSV
GCSIGGVAFARLADTLGRRLAIVIVVLVYMVGAIIQISSNHKWYQYFVGKIIYGLGAGGC
SVLCPMLLSEIAPTDLRGGLVSLYQLNMTFGIFLGYCSVYGTRKYSNTAQWRIPVGLCFL
WALIIIVGMLLVPESPRYLIECERHEEACVSIAKINKVSPEDPWVLKQADEINAGVLAQR
ELGEASWKELFSVKTKVLQRLITGILVQTFLQLTGENYFFFYGTTIFKSVGLTDGFETSI
VLGTVNFFSTIIAVMVVDKIGRRKCLLFGAASMMACMVIFASIGVCKLYPHGQDGPSSKG
AGNAMIVFTCFYIFCFATTWAPVAYIVVAESFPSKVKSKAMSISTAFNWLWQFLIGFFTP
FITGSIHFYYGYVFVGCLVAMFLYVFFFLPETIGLSLEEIQLLYEEGIKPWKSASWVPPS
RRGASSRETEAKKKSWKEVLKFPKSFN SEQ ID NO: 97
YDL247W
>sp|P0CD99|MPH2_YEAST Alpha-glucosides permease MPH2
OS = Saccharomyces cerevisiae (strain ATCC 204508 / S288c) GN = MPH2
PE = 2 SV = 1
MKNLSFLINRRKENTSDSNVYPGKAKSHEPSWIEMDDQTKKDGLDIVHVEFSPDTRAPSD
SNKVITEIFDATEDAKEADESERGMPLATALNTYPKAAAWSLLVSTTLIMEGYDTAILGA
FYALPIFQRKEGSQNDKTGEWEISASWQIGLTLCYMAGEIVGLQLTGPSVDLVGNRYTLI
IALFFLAAFTFILYFCNSLGMIAVGQALCGMPWGCFQCLTVSYASEICPLALRYYLTTYS
NLCWLFGQLFAAGIMKNSQKKYADSELGYKLPFALQWILPVPLALGIFFAPESPWWLVKK
GRFDEARRSLRRTLSGKGPEKEILVTLEVDKIKVTIDKEKRLTSKEGSYSDCFEDKINRR
RTRITCLCWAGQATCGSILIGYSTYFYEKAGVSTEMSFTFSIIQYCLGICATFLSWWASK
YFGRYDLYAFGLAFQTIVFFIIGGLGCSSTHGSKMGSGSLLMAVAFFYNLGIAPVVFCLV
SEMPSSRLRTKTIILARNTYNVVSIICSVLILYQLNSKKWNWGAKSGFFWGVLCFCTLIW
AVVDLPETAGKTFVEINELFKLGVSARKFKSTKVDPFVVKTPLKTSLITTPREISKLPLQ
RNSNVSHHL SEQ ID NO: 98
YDR011W
>sp|P32568|SNQ2_YEAST Protein SNQ2 OS = Saccharomyces cerevisiae
(strain ATCC 204508 / S288c) GN = SNQ2 PE = 1 SV = 2
MSNIKSTQDSSHNAVARSSSASFAASEESFTGITHDKDEQSDTPADKLTKMLTGPARDTA
SQISATVSEMAPDVVSKVESFADALSRHTTRSGAFNMDSDSDDGFDAHAIFESFVRDADE
QGIHIRKAGVTIEDVSAKGVDASALEGATFGNILCLPLTIFKGIKAKRHQKMRQIISNVN
ALAEAGEMILVLGRPGAGCSSFLKVTAGEIDQFAGGVSGEVAYDGIPQEEMMKRYKADVI
YNGELDVHFPYLTVKQTLDFAIACKTPALRVNNVSKKEYIASRRDLYATIFGLRHTYNTK
VGNDFVRGVSGGERKRVSIAEALAAKGSIYCWDNATRGLDASTALEYAKAIRIMTNLLKS
TAFVTIYQASENIYETFDKVTVLYSGKQIYFGLIHEAKPYFAKMGYLCPPRQATAEFLTA
LTDPNGFHLIKPGYENKVPRTAEEFETYWLNSPEFAQMKKDIAAYKEKVNTEKTKEVYDE
SMAQEKSKYTRKKSYYTVSYWEQVKLCTQRGFQRIYGNKSYTVINVCSAIIQSFITGSLF
YNTPSSTSGAFSRGGVLYFALLYYSLMGLANISFEHRPILQKHKGYSLYHPSAEAIGSTL
ASFPFRMIGLTCFFIILFFLSGLHRTAGSFFTIYLFLTMCSEAINGLFEMVSSVCDTLSQ
ANSISGILMMSISMYSTYMIQLPSMHPWFKWISYVLPIRYAFESMLNAEFHGRHMDCANT
LVPSGGDYDNLSDDYKVCAFVGSKPGQSYVLGDDYLKNQFQYVYKHTWRNFGILWCFLLG
```

TABLE 14-continued

Sequences disclosed herein.

```
YVVLKVIFTEYKRPVKGGGDALIFKKGSKRFIAHADEESPDNVNDIDAKEQFSSESSGAN
DEVFDDLEAKGVFIWKDVCFTIPYEGGKRMLLDNVSGYCIPGTMTALMGESGAGKTTLLN
TLAQRNVGIITGDMLVNGRPIDASFERRTGYVQQQDIHIAELTVRESLQFSARMRRPQHL
PDSEKMDYVEKIIRVLGMEEYAEALVGEVGCGLNVEQRKKLSIGVELVAKPDLLLFLDEP
TSGLDSQSSWAIIQLLRKLSKAGQSILCTIHQPSATLFEEFDRLLLLRKGGQTVYFGDIG
KNSATILNYFERNGARKCDSSENPAEYILEAIGAGATASVKEDWHEKWLNSVEFEQTKEK
VQDLINDLSKQETKSEVGDKPSKYATSYAYQFRYVLIRTSTSFWRSLNYIMSKMMLMLVG
GLYIGFTFFNVGKSYVGLQNAMFAAFISIILSAPAMNQIQGRAIASRELFEVRESQSNMF
HWSLVLITQYLSELPYHLFFSTIFFVSSYFPLRIFFEASRSAVYFLNYCIMFQLYYVGLG
LMILYMSPNLPSANVILGLCLSFMLSFCGVTQPVSLMPGFWTFMWKASPYTYFVQNLVGI
MLHKKPVVCKKKELNYFNPPNGSTCGEYMKPFLEKATGYIENPDATSDCAYCIYEVGDNY
LTHISSKYSYLWRNFGIFWIYIFFNIIAMVCVYYLFHVRQSSFLSPVSILNKIKNIRKKK
Q

SEQ ID NO: 99
YDR292C
>sp|P32916|SRPR_YEAST Signal recognition particle receptor subunit
alpha homolog OS = Saccharomyces cerevisiae (strain ATCC 204508 /
S288c) GN = SRP101 PE = 1 SV = 2
MFDQLAVFTPQGQVLYQYNCLGKKFSEIQINSFISQLITSPVTRKESVANANTDGFDFNL
LTINSEHKNSPSFNALFYLNKQPELYFVVTFAEQTLELNQETQQTLALVLKLWNSLHLSE
SILKNRQGQNEKNKHNYVDILQGIEDDLKKFEQYFRIKYEESIKQDHINPDNFTKNGSVP
QSHNKNTKKKLRDTKGKKQSTGNVGSGRKWGRDGGMLDEMNHEDAAKLDFSSSNSHNSSQ
VALDSTINKDSFGDRTEGGDFLIKEIDDLLSSHKDEITSGNEAKNSGYVSTAFGFLQKHV
LGNKTINESDLKSVLEKLTQQLITKNVAPEAADYLTQQVSHDLVGSKTANWTSVENTARE
SLTKALTQILTPGVSVDLLREIQSKRSKKDEEGKCDPYVFSIVGVNGVGKSTNLSKLAFW
LLQNNFKVLIVACDTFRSGAVEQLRVHVENLAQLMDDSHVRGSKNKRGKTGNDYVELFEA
GYGGSDLVTKIAKQAIKYSRDQNFDIVLMDTAGRRHNDPTLMSPLKSFADQAKPDKIIMV
GEALVGTDSVQQAKNFNDAFGKGRNLDFFIISKCDTVGEMLGTMVNMVYATGIPILFVGV
GQTYTDLRTLSVKWAVNTLMS SEQ ID NO: 100
YDR497C
>sp|P30605|ITR1_YEAST Myo-inositol transporter 1 OS = Saccharomyces
cerevisiae (strain ATCC 204508 / S288c) GN = ITR1 PE = 1 SV = 2
MGIHIPYLTSKTSQSNVGDAVGNADSVEFNSEHDSPSKRGKITLESHEIQRAPASDDEDR
IQIKPVNDEDDTSVMITFNQSLSPFIITLTFVASISGFMFGYDTGYISSALISIGTDLDH
KVLTYGEKEIVTAATSLGALITSIFAGTAADIFGRKRCLMGSNLMFVIGAILQVSAHTFW
QMAVGRLIMGFGVGIGSLIAPLFISEIAPKMIRGRLTVINSLWLTGGQLVAYGCGAGLNy
VNNGWRILVGLSLIPTAVQFTCLCFLPDTPRYYVMKGDLARATEVLKRSYTDTSEEIIER
KVEELVTLNQSIPGKNVPEKVWNTIKELHTVPSNLRALIIGCGLQAIQQFTGWNSLMYFS
GTIFETVGFKNSSAVSIIVSGTNFIFTLVAFFSIDKIGRRTILLIGLPGMTMALVVCSIA
FHFLGIKFDGAVAVVVSSGFSSWGIVIIVFIIVFAAFYALGIGTVPWQQSELFPQNVRGI
GTSYATATNWAGSLVIASTFLTMLQNITPAGTFAFFAGLSCLSTIFCYFCYPELSGLELE
EVQTILKDGFNIKASKALAKKRKQQVARVHELKYEPTQEIIEDI SEQ ID NO: 101
YEL006W
>sp|P39953|YEA6_YEAST Mitochondrial nicotinamide adenine
dinucleotide transporter 2 OS = Saccharomyces cerevisiae (strain ATCC
204508 / S288c) GN = YEA6 PE = 1 SV = 1
MNNGDNKTTLENSKNASLANGNYAIPTKLNRLKKNADPRVAAISGALSGALSAMLVCPFD
VAKTRLQAQGLQNMTHQSQHYKGFFGTFATIFKDEGAAGLYKGLQPTVLGYIPTLMIYFS
VYDFCRKYSVDIFPHSPFLSNASSAITAGAISTVATNPIWVVKTRLMLQTGIGKYSTHYK
GTIDTFRKIIQQEGAKALYAGLVPALLGMLNVAIQFPLYENLKIRFGYSESTDVSTDVTS
SNFQKLILASMLSKMVASTVTYPHEILRTRMQLKSDLPNTVQRHLLPLIKITYRQEGFAG
FYSGFATNLVRTVPAAVVTLVSFEYSKKYLTTFFQ SEQ ID NO: 102
YEL027W
>sp|P25515|VATL1_YEAST V-type proton ATPase subunit c
OS = Saccharomyces cerevisiae (strain ATCC 204508 / S288c) GN = VMA3
PE = 1 SV = 1
MTELCPVYAPFFGAIGCASAIIFTSLGAAYGTAKSGVGICATCVLRPDLLFKNIVPVIMA
GIIAIYGLVVSVLVCYSLGQKQALYTGFIQLGAGLSVGLSGLAAGFAIGIVGDAGVRGSS
QQPRLFVGMILILIFAEVLGLYGLIVALLLNSRATQDVVC SEQ ID NO: 103
YEL065W
>sp|P39980|SIT1_YEAST Siderophore iron transporter 1
OS = Saccharomyces cerevisiae (strain ATCC 204508 / S288c) GN = SIT1
PE = 3 SV = 1
MDPGIANHTLPEEFEEVVVPEMLEKEVGAKVDVKPTLTTSSPAPSYIELIDPGVHNIEIY
AEMYNRPIYRVALFFSLFLIAYAYGLDGNIRYTFQAYATSSYSQHSLLSTVNCIKTVIAA
VGQIFFARLSDIFGRFSIMIVSIIFYSMGTIIESQAVNITRFAVGGCFYQLGLTGIILIL
EVIASDFSNLNWRLLALFIPALPFIINTWISGNVTSAIDANWKWGIGMWAFILPLACIPL
GICMLHMRYLARKHAKDRLKPEFEALNKLKWKSFCIDIAFWKLDIIGMLLITVFFGCVLV
PFTLAGGLKEEWKTAHIIVPEVIGWVVVLPLYMLWEIKYSRHPLTPWDLIQDRGIFFALL
```

TABLE 14-continued

Sequences disclosed herein.

IAFFINFNWYMQGDYMYTVLVVAVHESIKSATRITSLYSFVSVIVGTILGFILIKVRATK
PPIIFGISCWIVSFGLLVHYRGDSGAHSGIIGSLCLLGFGAGSFTYVTQASIQASAKTHA
RMAVVTSLYLATYNIGSAFGSSVSGAVWTNILPKEISKRISDPTLAAQAYGSETTFITTY
TWGTPERIALVMSYRYVQKILCIIGLVFCFPLLGCAFMLRNHKLTDSIALEGNDHLESKN
TFEIEEKEESFLKNKFFTHFTSSKDRKD

SEQ ID NO: 104
YER019C-A
>sp|P52871|SC6B2_YEAST Protein transport protein SBH2
OS = Saccharomyces cerevisiae (strain ATCC 204508 / S288c) GN = SBH2
PE = 1 SV = 1
MAASVPPGGQRILQKRRQAQSIKEKQAKQTPTSTRQAGYGGSSSSILKLYTDEANGFRVD
SLVVLFLSVGFIFSVIALHLLTKFTHII SEQ ID NO: 105
YER053C
>sp|P40035|PIC2_YEAST Mitochondrial phosphate carrier protein 2
OS = Saccharomyces cerevisiae (strain ATCC 204508 / S288c) GN = PIC2
PE = 1 SV = 1
MESNKQPRKIQLYTKEFYATCTLGGIIACGPTHSSITPLDLVKCRLQVNPKLYTSNLQGF
RKIIANEGWKKVYTGFGATFVGYSLQGAGKYGGYEYFKHLYSSWLSPGVTVYLMASATAE
FLADIMLCPFEAIKVKQQTTMPPFCNNVVDGWKKMYAESGGMKAFYKGIVPLWCRQIPYT
MCKFTSFEKIVQKIYSVLPKKKEEMNALQQISVSFVGGYLAGILCAAVSHPADVMVSKIN
SERKANESMSVASKRIYQKIGFTGLWNGLMVRIVMIGTLTSFQWLIYDSFKAYVGLPTTG SEQ ID NO: 106
YER119C
>sp|P40074|AVT6_YEAST Vacuolar amino acid transporter 6
OS = Saccharomyces cerevisiae (strain ATCC 204508 / S288c) GN = AVT6
PE = 1 SV = 1
MVASIRSGVLTLLHTACGAGILAMPYAFKPFGLIPGVIMIVLCGACAMQSLFIQARVAKY
VPQGRASFSALTRLINPNLGIVFDLAIAIKCFGVGVSYMIVVGDLMPQIMSVWTRNAWLL
NRNVQISLIMLFFVAPLSFLKKLNSLRYASMVAISSVAYLCVLVLLHVVAPSDEILRLKG
RISYLLPPQSHDLNVLNTLPIFVFAYTCHHNMFSIINEQRSSRFEHVMKIPLIAISLALI
LYIAIGCAGYLTFGDNIIGNIIMLYPQAVSSTIGRIAIVLLVMLAFFPLQCHPARASIHQI
LQHFAEENVSISATSADEPTVATESSPLIRDSSLDLNEVIEEESIYQPKETPLRGKSFIV
ITCSILVASYLVAISVSSLARVLAIVGATGSTSISFILPGLFGYKLIGTEHKTAVPLTTK
IFKYTGLLLFIWGLIIMITCLTAALKLN SEQ ID NO: 107
YFL028C
>sp|P43569|CAF16_YEAST CCR4-associated factor 16 OS = Saccharomyces
cerevisiae (strain ATCC 204508 / S288c) GN = CAF16 PE-1 SV = 1
MVSQFAIEVRNLTYKFKESSDPSVVDINLQIPWNTRSLVVGANGAGKSTLLKLLSGKHLC
LDGKILVNGLDPFSPLSMNQVDDDESVEDSTNYQTTTYLGTEWCHMSIINRDIGVLELLK
SIGFDHFRERGERLVRILDIDVRWRMHRLSDGQKRRVQLAMGLLKPWRVLLLDEVTVDLD
VIARARLLEFLKWETETRRCSVVYATHIFDGLAKWPNQVYHMKSGKIVDNLDYQKDVEFS
EVVNAKVNGQVAFENDNNKVVISKVNSLHPLALEWLKRDNQIPDKEIGI SEQ ID NO: 108
YFR045W
>sp|P43617|YFL5_YEAST Uncharacterized mitochondrial carrier YFR045W
OS = Saccharomyces cerevisiae (strain ATCC 204508 / S288c) GN = YFR045W
PE = 1 SV = 3
MANQNSDLYKQITAGSVAAVFQTTMTYPFEYLKTGLQLQPKGTAFEIILPQIKSYFVGCS
ALNVAAFGKTILRFVTFDKLCHSLNNNIDNNDNFQRLTGYNLLIAGTLTGIVESLFIIPF
ENIKTTLIQSAMIDHKKLEKNQPVVNAKATFHKVATKSTPVARIEKLLPAVKHMYQTRGP
AAFVQGTTATIFRQIANTSIQFTAYTAFKRLLQARNDKASSVITGLATSFTLVAMTQPID
VVKTRMMSQNAKTEYKNTLNCMYRIFVQEGMATFWKGSIFRFMKVGISGGLTFTVYEQVS
LLLGFSSRS SEQ ID NO: 109
YGL084C
>sp|P53154|GUP1_YEAST Glycerol uptake protein 1 OS = Saccharomyces
cerevisiae (strain ATCC 204508 / S288c) GN = GUP1 PE = 1 SV = 1
MSLISILSPLITSEGLDSRIKPSPKKDASTTTKPSLWKTTEFKFYYIAFLVVVPLMFYAG
LQASSPENPNYARYERLLSQGWLFGRKVDNSDSQYRFFRDNFALLSVLMLVHTSIKRIVL
YSTNITKLRFDLIFGLIFLVAAHGVNSIRILAHMLILYAIAHVLKNFRRIATISIWIYGI
STLFINDNFRAYPFGNICSFLSPLDHWYRGIIPRWDVFFNFTLLRVLSYNLDFLERWENL
QKKKSPSYESKEAKSAILLNERARLTAAHPIQDYSLMNYIAYVTYTPLFIAGPIITFNDY
VYQSKHTLPSINFKFIPYYAVRFVIALLSMEFILHFLHVVAISKTKAWENDTPFQISMIG
LFNLNIIWLKLLIPWRLFRLWALLDGIDTPENMIRCVDNNYSSLAFWRAWHRSYNKWVVR
YIYIPLGGSKNRVLTSLAVFSFVAIWHDIELKLLLWGWLIVLFLLPEIFATQIFSHYTDA
VWYRHVCAVGAVFNIWVMMIANLFGFCLGSDGTKKLLSDMFCTVSGFKFVILASVSLFIA
VQIMFEIREEEKRHGIYLKC TABLE 14-continued Sequences disclosed herein.

SEQ ID NO: 110
YGL104C
>sp|P53142|VPS73_YEAST Vacuolar protein sorting-associated protein
73 OS = Saccharomyces cerevisiae (strain ATCC 204508 / S288c) GN = VPS73
PE = 1 SV = 1
MNRILSSASLLSNVSMPRQNKHKITKALCYAIIVASIGSIQFGYHLSELNAPQQVLSCSE
FDIPMEGYPYDRTWLGKRGYKQCIPLNDEQIGIVTSVFCIGGILGSYFATSLANIYGRKF
SSLINCTLNIVGSLIIFNSNSYRGLIIGRILVGISCGSLIVIIPLFIKEVAPSGWEGLLG
SMTQICIRLGVLLTQGIALPLTDSYRWRWILFGSFLIAVLNFFMWFIVDESPKWLLAHGR
VTDAKLSLCKLRGVTFDEAAQEIQDWQLQIESGDPLIEPTTTNSISGSNSLWKYLRDRTN
VKSRHVITVLLFGQQFCGINSIVLYGTKIISQLYPQHAIRINFFISMVNVLVTILVSLLI
HSLPRKPLLMTSTVLVSVTAFIMGIAMNHNKMNLLIVFSFIYMGVFTMGLNPLPFIIMRE
VSKPQDMVLAQRYGTICNWVGTFIIAYTFPIIHDVLSGYVFIIFAIIACSISAFIWKKVP
ETKRSG SEQ ID NO: 111
YGL114W
>sp|P53134|YGL4_YEAST Putative oligopeptide transporter YGL114W
OS = Saccharomyces cerevisiae (strain ATCC 204508 / S288c) GN = YGL114W
PE = 1 SV = 1
MPQSTPSQEVQRVPWDNKPALKQITLRATIAGIAIGSLVLTSNFQFGLQTGWVSMMSLPS
ALLACAFFKNIWPLIFPNDRPFSDVENVYVQSMAVAVGTGPLAFGFVGVIPAIEKFLTND
ESGGLREQGQSFTFRELLIWSTALAFFGIFFAVPLRKQVIVREKLPFPSGSATATLISVL
NGTEILQEVSKSELLEMRQRRLNECPEVLQPNRDPEEADYLMNSSHSELGDYTATSQDGS
SILSTGSENYRANIIILLKTFVVSSLYTMVSYFVPVIRSIPVFGKYLSNNYLWNFQPSPA
YIGQIIMGLPTVSYMLIGCFLGWGVLAPLARYKRWVPPDADVHDWEEGVQGWILWSSLS
IMVADSVVAFIVVTVKSIVKFILIDDKAALLNNIIDDTFQSMLLEEERAINSSRRNTYVD
GRQDTVRLVSRDNEIEVDSKHLVRYTTVISGCLVSSIICIVSIIYLFGIQVIPLYAIITA
LILALFLSILGIRALGETDLNPVSGIGKISQLIFAFIIPRDRPGSVLMNVVSGGIAEASA
QQAGDLMQDLKTGHLLGASPRAQFCAQLIGACWSIILSSFMYLCYNKVYSIPSEQFRIPT
AVVWIDCARLVTGKGLPDKALECSMILGVIFAVLSLIRNTYRDYGYGWILYIPSGVAVGV
GIFNSPSFTIARFIGGWASHFWLKNHRGDLNAKTKMIVFSSGLVLGEGIFSVINMLFICL
NVPHY SEQ ID NO: 112
YGL167C
>sp|P13586|ATC1_YEAST Calcium-transporting ATPase 1 OS = Saccharomyces
cerevisiae (strain ATCC 204508 / S288c) GN = PMR1 PE = 1 SV = 1
MSDNPFNASLLDEDSNREREILDATAEALSKPSPSLEYCTLSVDEALEKLDTDKNGGLRS
SNEANNRRSLYGPNEITVEDDESLFKKFLSNFIEDRMILLLIGSAVVSLFMGNIDDAVSI
TLAIFIVVTVGFVQEYRSEKSLEALNKLVPAECHLMRCGQESHVLASTLVPGDLVHFRIG
DRIPADIRIIEAIDLSIDESNLTGENEPVHKTSQTIEKSSFNDQPNSIVPISERSCIAYM
GTLVKEGHGKGIVVGTGTNTSFGAVFEMMNNIEKPKTPLQLTMDKLGKDLSLVSFIVIGM
ICLVGIIQGRSWLEMFQISVSLAVAAIPEGLLPIIVTVTLALGVLRMAKRKAIVRRLPSVE
TLGSVNVICSDKTGTLTSNHMTVSKLWCLDSMSNKLNVLSLDKNKKTKNSGNLKNYLTE
DVRETLTIGNLCNNASFSQEHAIFLGNPTDVALLEQLANFEMPDIRNTVQKVQELPFNSK
RKLMATKILNPVDNKCTVYVKGAFERILEYSTSYLKSKGKKTEKLTEAQKATINECANSM
ASEGLRVFGFAKLTLSDSSTPLTEDLIKDLTFTGLIGMNDPPRPNVKFAIEQLLQGGVHI
IMITGDSENTAVNIAKQIGIPVIDPKLSVLSGDKLDEMSDDQLANVIDHVNIFARATPEH
KLNIVRALRKRGDVVAMTGDGVNDAPALKLSDIGVSMGRIGTDVAKEASDMVLTDDDFST
ILTAIEEGKGIFNNIQNFLTFQLSTSVAALSLVALSTAFKLPNPLNAMQILWINILMDGP
PAQSLGVEPVDHEVMKKPPRKRTDKILTHDVMKRLLTTAACIIVGTVYIFVKEMAEDGKV
TARDTTMTFCFVFFDMFNALACRHNTKSIFEIGFFTNKMFNYAVGLSLLGQMCAIYIPF
FQSIFKTEKLGISDILLLLLISSSVFIVDELRKLWTRKKNEEDSTYFSNV SEQ ID NO: 113
YGR257C
>sp|P53320|MTM1_YEAST Mitochondrial carrier protein MTM1
OS = Saccharomyces cerevisiae (strain ATCC 204508 / S288c) GN = MTM1
PE = 1 SV = 1
MSDRNTSNSLTLKERMLSAGAGSVLTSLILTPMDVVRIRLQQQQMIPDCSCDGAAEVPNA
VSSGSKMKTFTNVGGQNLNNAKIFWESACFQELHCKNSSLKFNGTLEAFTKIASVEGITS
LWRGISLTLLMAIPANMVYFSGYEYIRDVSPIASTYPTLNPLFCGAIARVFAATSIAPLE
LVKTKLQSIPRSSKSTKTWMMVKDLLNETRQEMKMVGPSRALFKGLEITLWRDVPFSAIY
WSSYELCKERLWLDSTRFASKDANWVHFINSFASGCISGMIAAICTHPFDVGKTRWQISM
MNNSDPKGGNRSRNMFKFLETIWRTEGLAALYTGLAARVIKIRPSCAIMISSYEISKKVF
GNKLHQ SEQ ID NO: 114
YHL035C
>sp|P38735|VMR1_YEAST ABC transporter ATP-binding protein/permease
VMR1 OS = Saccharomyces cerevisiae (strain ATCC 204508 / S288c)
GN = VMR1 PE = 2 SV = 1
MGTDPLIIRNNGSFWEVDDFTRLGRTQLLSYYLPLAIIASIGIFALCRSGLSRYVRSAEC
DLVNEYLFGAQEERKEDNSIERLLRNSNTQANYVNVKKQGRILKLRHFDITTIDVKQIDA
KNHGGLTFSRPSTSDHLRKSSEIVLMSLQIIGLSFLRVTKINIELTNRDVTTLLLFWLIL
LSLSILRVYKRSTNLWAICFTAHTTIWISTWIPIRSVYIGNIDDVPSQIFYIFEFVITST
LQPIKLTSPIKDNSSIIYVRDDHTSPSREHISSILSCITWSWITNFIWEAQKNTIKLKDI TABLE 14-continued Sequences disclosed herein.

WGLSMEDYSIFILKGFTRRNKHINNLTLALFESFKTYLLIGMLWVLVNSIVNLLPTILMK
RFLEIVDNPNRSSSCMNLAWLYIIGMFICRLTLAICNSQGQFVSDKICLRIRAILIGEIY
AKGLRRRLFTSPKTSSDSDSISANLGTIINLISIDSFKVSELANYLYVTVQAVIMIIVVV
GLLFNFLGVSAFAGISIILVMFPLNFLLANLLGKFQKQTLKCTDQRISKLNECLQNIRIV
KYFAWERNIINEIKSIRQKELRSLLKKSLVWSVTSFLWFVTPTLVTGVTFAICTFVQHED
LNAPLAFTTLSLFTLLKTPLDQLSNMLSFINQSKVSLKRISDFLRMDDTEKYNQLTISPD
KNKIEFKNATLTWNENDSDMNAFKLCGLNIKFQIGKLNLILGSTGSGKSALLLGLLGELN
LISGSIIVPSLEPKHDLIPDCEGLTNSFAYCSQSAWLLNDTVKNNIIFDNFYNEDRYNKV
IDACGLKRDLEILPAGDLTEIGEKGITLSGGQKQRISLARAVYSSAKHVLLDDCLSAVDS
HTAVWIYENCITGPLMKNRTCILVTHNVSLTLRNAHFAIVLENGKVKNQGTITELQSKGL
FKEKYVQLSSRDSINEKNANRLKAPRKNDSQKIEPVTENINFDANFVNDGQLIEEEEKSN
GAISPDVYKWYLKFFGGFKALTALFALYITAQILFISQSWWIRHWVNDTNVRINAPGFAM
DTLPLKGMTDSSKNKHNAFYYLTVYFLIGIIQAMLGGFKTMMTFLSGMRASRKIFNNLLD
LVLHAQIRFFDVTPVGRIMNRFSKDIEGVDQELIPYLEVTIFCLIQCASIIFLITVITPR
FLTVAVIVFVLYFFVGKWYLTASRELKRLDSITKSPIFQHFSETLVGVCTIRAFGDERRF
ILENMNKIDQNNRAFFYLSVTVKWFSFRVDMIGAFIVLASGSFILLNIANIDSGLAGISL
TYAILFTDGALWLVRLYSTFEMNMNSVERLKEYSSIEQENYLGHDEGRILLLNEPSWPKD
GEIEIENLSLRYAPNLPPVIRNVSFKVDPQSKIGIVGRTGAGKSTIITALFRLLEPITGC
IKIDGQDISKIDLVTLRRSITIIPQDPILFAGTIKSNVDPYDEYDEKKIFKALSQVNLIS
SHEFEEVLNSEERFNSTHNKFLNLHTEIAEGGLNLSQGERQLLFIARSLLREPKIILLDE
ATSSIDYDSDHLIQGIIRSEFNKSTILTIAHRLRSVIDYDRIIVMDAGEVKEYDRPSELL
KDERGIFYSMCRDSGGLELLKQIAKQSSKMMK

SEQ ID NO: 115
YHL036W
>sp|P38734|MUP3_YEAST Low-affinity methionine permease
OS = *Saccharomyces cerevisiae* (strain ATCC 204508 / S288c) GN = MUP3
PE = 1 SV = 1
MEPLLFNSGKANPSQDVFIDVEVGDITTKYGSTNTGSFSSMDTVEAQAIKAETARFMEVP
QGRHLGVFSTVVLFVSRIMGSGIFAVPSVILLNTGGNKLIYFAIWVFSAAIAFAGLYIFL
EFGSWIPKSGGRKNFLERSFERPRLLISVVFSCYSVLTGYALTGSIVFGKYVLSAFGVTD
DSWSKYVSISFIIFAVLIHGVSVRHGVFIQNALGGLKLIMIVLMCFAGLYTLFFYKSTGQ
VAWDLPVTQVEKDSLLSVSSIATAFISSFFCFSGWDTVHTVTSEIKNPVKTLKVSGPLSL
IICFVCYTMMNVAYLKVLTYEEIVSAGPLVGSVLFTKLFGPRVGGKFIAFSIAISAASNI
LVVIYSISRVNQEIFKEGYLPFSIHMSKNWPFDAPLPSISLCGFITIAWILILPKEGESF
NYLVSMDGYGNQFFLLLVAIGLFIWRFKHKNEVPEIRASTFGVLAITTLSLYMLMAPFFA
DPSLNRVGFLPPYQIMSLLVIVACFFFWLVKFVLLPKFFHYKLLPKITYLHDGLIVTEWV
KKPCLC SEQ ID NO: 116
YHR002W
>sp|P38702|LEU5_YEAST Mitochondrial carrier protein LEU5
OS = *Saccharomyces cerevisiae* (strain ATCC 204508 / S288c) GN = LEU5
PE = 3 SV = 1
MTRDSPDSNDSYKHINKNTTQKTSFDRNSFDYIVRSGLAGGISGSCAKTLIAPLDRIKIL
FQTSNPHYTKYTGSLIGLVEAAKHIWINDGVRGFFQGHSATLLRIFPYAAVKFVAYEQIR
NTLIPSKEFESHWRRLVSGSLAGLCSVFITYPLDLVRVRLAYETEHKRVKLGRIIKKIYK
EPASATLIKNDYIPNWFCHWCNFYRGYVPTVLGMIPYAGVSFFAHDLLHDVLKSPFFAPY
SVLELSEDDELERVQKKQRRPLRTWAELISGGLAGMASQTAAYPFEIIRRRLQVSALSPK
TMYDHKFQSISEIAHIIFKERGVRGFFVGLSIGYIKVTPMVACSFFNNERMKWNFGI SEQ ID NO: 117
YHR096C
>sp|P38695|HXT5_YEAST Probable glucose transporter HXT5
OS = *Saccharomyces cerevisiae* (strain ATCC 204508 / S288c) GN = HXT5
PE = 1 SV = 1
MSELENAHQGPLEGSATVSTNSNSYNEKSGNSTAPGTAGYNDNLAQAKPVSSYISHEGPP
KDELEELQKEVDKQLEKKSKSDLLFVSVCCLMVAFGGFVFGWDTGTISGFVRQTDFIRRF
GSTRANGTTYLSDVRTGLMVSIFNIGCAIGGIVLSKLGDMYGRKIGLMTVVVIYSIGIII
QIASIDKWYQYFIGRIISGLGVGGITVLAPMLISEVSPKQLRGTLVSCYQLMITFGIFLG
YCTNFGTKNYSNSVQWRVPLGLCFAWSIFMIVGMTFVPESPRYLVEVGKIEEAKRSLARA
NKTTEDSPLVTLEMENYQSSIEAERLAGSASWGELVTGKPQMFRRTLMGMMIQSLQQLTG
DNYFFYYGTTIFQAVGLEDSFETAIVLGVVNPVSTFFSLYTVDRFGRRNCLLWGCVGMIC
CYVVYASVGVTRLWPNGQDQPSSKGAGNCMIVFACFYIFCFATTWAPVAYVLISESYPLR
VRGKAMSIASACNWIWGFLISFFTPFITSAINFYYGYVFMGCMVFAYFYVFFFVPETKGL
TLEEVNEMYEENVLPWKSTKWIPPSRRTTDYDLDATRNDPRPFYKRMFTKEK SEQ ID NO: 118
YIL006W
>sp|P40556|YIA6_YEAST Mitochondrial nicotinamide adenine
dinucleotide transporter 1 OS = *Saccharomyces cerevisiae* (strain ATCC
204508 / S288c) GN = YIA6 PE = 1 SV = 1
MTQTDNPVPNCGLLPEQQYCSADHEEPLLLHEEQLIFPDHSSQLSSADIIEPIKMNSSTE
SIIGTTLRKKWVPLSSTQITALSGAFAGFLSGAVCPLDVAKTRLQAGGLQTRFENPYYR
GIMGTLSTIVRDEGPRGLYKGLVPIVLGYFPTWMIYFSVYEFSKKFFHGIFPQFDFVAQS
CAAITAGAASTTLTNPIWVVKTRLMLQSNLGEHPTHYKGTFDAFRKLFYQEGFKALYAGL
VPSLLGLFHVAIHFPIYEDLKVRFHCYSRENNTNSINLQRLIMASSVSKMIASAVTYPHE TABLE 14-continued Sequences disclosed herein.

ILRTRMQLKSDIPDSIQRRLFPLIKATYAQEGLKGFYSGFTTNLVRTIPASAITLVSFEY
FRNRLENISTMVI

SEQ ID NO: 119
YIL120W
>sp|P40475|QDR1_YEAST Quinidine resistance protein 1
OS = Saccharomyces cerevisiae (strain ATCC 204508 / S288c) GN = QDR1
PE = 1 SV = 1
MTKQQTSVMRNASIAKEEREGSDNNNVDRSSSDAISDNDAERSNSHSEIDNESNFDMVPY
SRFSHKQKMLLVVQCAFTGFFSTVAGSIYYPVLTIIERKFNITEELANVTIVVYFIFQGV
APSIMGGLADTFGRRPIVLWAILAYFCACIGLACAHNYAQILALRCLQAAGISPVIAINS
GIMGDVTTKVERGGYVGLVAGFQVVGTAFGALIGAGLSSKWGWRAIFWFLAIGSGICLVF
STLLMPETKRTLVGNGSVTPRSFLNRSLILHVGSVKKTLHLDDPDPETLEPRTSVDFLAP
LKILHIREIDILLSIAGLQFSTWTTHQTALTIVLSKKYNLSVAKIGLCFLPAGISTLTSI
ISAGRYLNWSYRTRKVKYNRWIKEQELQLMEKYKGDKNKVAELIHSNSHYAFNLVEARLH
PAFVTLLLSSIGFTAFGWCISVKTPLAAVLCTSAFASLFSNCILTFSTTLIVDLFPSKAS
TATGCLNLFRCLLSAIFIAALTKMVEKMRYGGVFTFLSAITSSSSLLLFYLLKNGKQLSF
DRI RANDKSAGRSVGKNSEKVST SEQ ID NO: 120
YIL121W
>sp|P40474|QDR2_YEAST Quinidine resistance protein 2
OS = Saccharomyces cerevisiae (strain ATCC 204508 / S288c) GN = QDR2
PE = 1 SV = 1
MAGATSSIIRENDFEDELAESMQSYNRETADKLALTRTESVKPEPEITAPPHSRFSRSFK
TVLIAQCAFTGFFSTIAGAIYYPVLSVIERKFDIDEELVNVTVVVYFVFQGLAPTFMGGF
ADSLGRRPVVLVAIVIYFGACIGLACAQTYAQIIVLRCLQAAGISPVIAINSGIMGDVTT
RAERGGYVGYVAGFQVLGSAFGALIGAGLSSRWGWRAIFWFLAIGSGICFLASFLILPET
KRNISGNGSVTPKSYLNRAPILVLPTVRKSLHLDNPDYETLELPTQLNLLAPFKILKAYE
ICILMLVAGLQFAMYTTHLTALSTALSKQYHLTVAKVGLCYLPSGICTLCSIVIAGRYLN
WNYRRRLKYYQNWLGKKRSKLLEEHDNDLNLVQRIIENDPKYTFNIFKARLQPAFVTLLL
SSSGFCAYGWCITVKAPLAAVLCMSGFASLFSNCILTFSTTLIVDLFPTKTSTATGCLNL
FRCILSAVFIAALSKMVEKMKFGGVFTFLGALTSSSSILLFILLRKGKELAFKRKKQELG
VN SEQ ID NO: 121
YIL166C
>sp|P40445|YIQ6_YEAST Uncharacterized transporter YIL166C
OS = Saccharomyces cerevisiae (strain ATCC 204508 / S288c) GN = YIL166C
PE = 1 SV = 1
MSVQKEEYDIVEKAQLSVSAESLTSDSESISHNPFDDFHKAERWRKVYESSGYEGLSKFD
PEFTWIKDEEKKLVRKMDLKIFLWVFIMFAFLDLIRKNIARAVSDNFIVDLKMNTNDYNL
GQTVYLVIFLASELPGNLLSKRFGPERVIPVQIVLWSVICITQAGLKNRGQFIATRCLLG
MVQGGFIPDNILYSYYYTGAELTFRLSFFWCAIPLFQILGSLLASGIIEMRGIHNLAGW
QYLFIIEGFLSLSVGVASFYLMRRGPTQTGESAFHKGKSLFTEYEEKIMVNRILRDDPSK
GDMSNRQPVTFKEILYTLTEFDLWPLFIQGITAFISLQTVGSYLSLILKSLNYSTFLSNI
LAIPGQALLLINLPLAALLSRKLKEKSLCVGIANVWVLPFIVSLVALPTDINPWIKYILL
TGILGLPYTHSILAGWVSEISNSVRSRTVGTALYNMSAQVGAIIASNMYRNDDKPYYTRG
NKILLGFICFNICMAVATKFYYISRNKYKDRKWNSMTKEEQINYLDTTKDKGMKRLDYRF
IH SEQ ID NO: 122
YJL133W
>sp|P10566|MRS3_YEAST Mitochondrial RNA-splicing protein MRS3
OS = Saccharomyces cerevisiae (strain ATCC 204508 / S288c) GN = MRS3
PE = 1 SV = 4
MVENSSSNNSTRPIPAIPMDLPDYEALPTHAPLYHQLIAGAFAGIMEHSVMFPIDALKTR
IQSANAKSLSAKNMLSQISHISTSEGTLALWKGVQSVILGAGPAHAVYFGTYEFCKKNLI
DSSDTQTHHPFKTAISGACATTASDALMNPFDTIKQRIQLNTSASVWQTTKQIYQSEGLA
AFYYSYPTTLVMNIPFAAFNFVIYESSTKFLNPSNEYNPLIHCLCGSISGSTCAAITTPL
DCIKTVLQIRGSQTVSLEIMRKADTFSKAASAIYQVYGWKGFWRGWKPRIVANMPATAIS
WTAYECAKHFLMTY SEQ ID NO: 123
YJL219W
>sp|P40885|HXT9_YEAST Hexose transporter HXT9 OS = Saccharomyces
cerevisiae (strain ATCC 204508 / S288c) GN = HXT9 PE = 1 SV = 1
MSGVNNTSANDLSTTESNSNSVANAPSVKTEHNDSKNSLNLDATEPPIDLPQKPLSAYTT
VAILCLMIAFGGFIFGWDTGTISGFVNLSDFIRRFGQKNDKGTYYLSKVRMGLIVSIFNI
GCAIGGIVLSKVGDIYGRRIGLITVTAIYVVGILIQITSINKWYQYFIGRIISGLGVGGI
AVLSPMLISEVAPKQIRGTLVQLYQLMCTMGIFLGYCTNYGTKNYHNATQWRVGLGLCFA
WTTFMVSGMMFVPESPRYLIEVGKDEEAKRSLSKSNKVSVDDPALLAEYDTIKAGIELEK
LAGNASWSELLSTKTKVFQRVLMGVMIQSLQQLTGDNYFFYYGTTIFKSVGLKDSFQTSI
IIGVVNFFSSFIAVYTIERFGRRTCLLWGAASMLCCFAVFASVGVTKLWPQGSSHQDITS
QGAGNCMIVFTMFFIFSFATTWAGGCYVIVSETFPLRVKSRGMAIATAANWMWGFLISFF
TPFITGAINFYYGYVFLGCLVFAYFYVFFFVPETKGLTLEEVNTMWLEGVPAWKSASWVP
PERRTADYDADAIDHDDRPIYKRFFSS

TABLE 14-continued

Sequences disclosed herein.

SEQ ID NO: 124
YKL016C
>sp|P30902|ATP7_YEAST ATP synthase subunit d, mitochondrial
OS = Saccharomyces cerevisiae (strain ATCC 204508 / S288c) GN-ATP7
PE = 1 SV = 2
MSLAKSAANKLDWAKVISSLRITGSTATQLSSFKKRNDEARRQLLELQSQPTEVDFSHYR
SVLKNTSVIDKIESYVKQYKPVKIDASKQLQVIESFEKHAMTNAKETESLVSKELKDLQS
TLDNIQSARPFDELTVDDLTKIKPEIDAKVEEMVKKGKWDVPGYKDRFGNLNVM SEQ ID NO: 125
YKL050C
>sp|P35736|YKF0_YEAST Uncharacterized protein YKL050C
OS = Saccharomyces cerevisiae (strain ATCC 204508 / S288c) GN = YKL050C
PE = 1 SV = 1
MSLISALQTTDVESVQTSPEQITERKAVRVSTLQESLHSSEMHRAAPETPRSISNSVHKL
KTIYSTYQQSGQPLSKEAIFRAKQKYGILNTPANYKTLGLGDSKSESVDLAARLASKRTK
VSPDDCVETAIEQKARGEAFKVTFSKIPLTPPEDVPITVNLGLKGRRDFLTRLAAQKALA
FSPSLDNSMKGTSDSSSVKKKRFSGAPIGNEFDANLVNPQHPAGFKSLDLSKVLDGAERR
AISRVNDRLYPQKVNFKNGLQSSDQSGVSKANKEVFKKGTLEKLEHSAEQFLESHAGNER
QRLSDQQYMCAKGAADAVKDLDPKTLEDPDFAAREAQKKLYIKQVASPVVLNEAQKLANR
KLQDIDSRDTYMLLFGNQAYNKLAVNIALQHYSVKQEEKKKIYLGGGLWMTPEEVNAVAK
KLISPVVNEIDERASRQRDVDKDIERRSRVLDQEYEDGNSMERAKEQNDGQLLLAMASKQ
QQEKEAKKAEEGQRYDQFVQKMNIKLQQKEKELENARENRENLRNELQERLSKNLSGEND
ELNDWNDACERDLKNSSIEHYYAVRSHFDNLGNSERGYDELLEERSKIQVEIERLVASIA
EHKTAIHGFGETADAGGAIPAVQKQKIPTRKDLLDATVNDPLVISAEMAKEEAEMATEEC
MLKELQVDEMIIRNIMLRECEKKLEEEKETAKRSRRGTEESKNNSNFSRDVIMSTPDNN
EKVIPIGKSASPKDVVKSRFLSTYNTGKDIDSSASARSITGVSGVLDDGPKTPTSNKENE
LIDDEVKSYKVHQAVDGTGEDSIANKRDKSSRPAANSGGSITIEQFLFNKNADKQGLSKT
ESVTMKREPVVDQMDSKKGHDFTHCNDNGRRSFSGFSQGSIENDYSNEVIDDQDDQEGSE
IRVRDSNDSNTSPKESFFKEVI SEQ ID NO: 126
YKL120W
>sp|P32332|OAC1_YEAST Mitochondrial oxaloacetate transport protein
OS = Saccharomyces cerevisiae (strain ATCC 204508 / S288c) GN = OAC1
PE = 1 SV = 1
MSSDNSKQDKQIEKTAAQKISKFGSFVAGGLAACIAVTVTNPIELIKIRMQLQGEMSASA
AKVYKNPIQGMAVIFKNEGIKGLQKGLNAAYIYQIGLNGSRLGFYEPIRSSLNQLFFPDQ
EPHKVQSVGVNVFSGAASGIIGAVIGSPLFLVKTRLQSYSEFIKIGEQTHYTGVWNGLVT
IPKTEGVKGLFRGIDAAILRTGAGSSVQLPIYNTAKNILVKNDLMKDGPALHLTASTISG
LGVAVVMNPWDVILTRIYNQKGDLYKGPIDCLVKTVRIEGVTALYKGFAAQVFRIAPHTI
MCLTFMEQTMKLVYSIESRVLGHN SEQ ID NO: 127
YKL146W
>sp|P36062|AVT3_YEAST Vacuolar amino acid transporter 3
OS = Saccharomyces cerevisiae (strain ATCC 204508 / S288c) GN = AVT3
PE = 1 SV = 1
MNGKEVSSGSGRTQSNNNKKNNNGGSTGISHASGSPLTDGNGGNSNGNSRSRSRSRKSSG
TTGGLLKKPPLLVNNEAVHASVPDASHTSCNNGTLEVSINNPEPHVVDAVARHLIRNPSN
SLQLQGGDITRDLYKWTNDHPSSPSQYQYPSQPALSTSIPSQAPSFSNRKRSMSFSAASI
ASSSHLNNNSEANGNPLAAIGLAPAPMTHEEIRAPGGFRRSFIIQKRRKHNVDAPIPNFF
TRNFIEFLTLYGHFAGEDLSEEEEEEETEEEPEEEALETESTQLVSREHGRHPHKSSTV
KAVLLLLKSFVGTGVLFLPKAFHNGGWGFSALCLLSCALISYGCFVSLITTKDKVGVDGY
GDMGRILYGPKMKFAILSSIALSQIGFSAAYTVFTATNLQVFSENFFHLKPGSISLATYI
FAQVLIFVPLSLTRNIAKLSGTALIADLFILLGLVYVYVYSIYYIAVNGVASDTMLMFNK
ADWSLFIGTAIFTFEGIGLLIPIQESMKHPKHFRPSLSAVMCIVAVIFISCGLLCYAAFG
SDVKTVVLLNFPQDTSYTLTVQLLYALAILLSTPLQLFPAIRILENWTFPSNASGKYNPK
VKWLKNYFRCAIVVLTSILAWVGANDLDKFVSLVGSFACIPLIYIYPPLLHYKASILSGT
SRARLLLDLIVIVFGVAVMAYTSWQTIKMWSQ SEQ ID NO: 128
YKL209C
>sp|P12866|STE6_YEAST Alpha-factor-transporting ATPase
OS = Saccharomyces cerevisiae (strain ATCC 204508 / S288c) GN = STE6
PE = 1 SV = 1
MNFLSFKTTKHYHIFRYVNIRNDYRLLMIMIIGTVATGLVPAITSILTGRVFDLLSVFVA
NGSHQGLYSQLVQRSMAVMALGAASVPVMWLSLTSWMHIGERQGFRIRSQILEAYLEEKP
MEWYDNNEKLLGDFTQINRCVEELRSSSAEASAITFQNLVAICALLGTSFYYSWSLTLII
LCSSPIITFFAVVFSRMIHVYSEKENSETSKAAQLLTWSMNAAQLVRLYCTQRLERKKFK
EIILNCNTFFIKSCFFVAANAGILRFLTLTMFVQGFWFGSAMIKKGKLNINDVITCFHSC
IMLGSTLNNTLHQIVVLQKGGVAMEKIMTLLKDGSKRNPLNKTVAHQFPLDYATSDLTFA
NVSFSYPSRPSEAVLKNVSLNFSAGQFTFIVGKSGSGKSTLSNLLLRFYDGYNGSISING
HNIQTIDQKLLIENITVVEQRCTLFNDTLRKNILLGSTDSVRNADCSTNENRHLIKDACQ
MALLDRFILDLPDGLETLIGTGGVTLSGGQQQRVAIARAFIRDTPILFLDEAVSALDIVH
RNLLMKAIRHWRKGKTTIILTHELSQIESDDYLYLMKEGEVVESGTQSELLADPTTTFST
WYHLQNDYSDAKTIVDTETEEKSIHTVESFNSQLETPKLGSCLSNLGYDETDQLSFYEAI
YQKRSNVRTRRVKVEEENIGYALKQQKNTESSTGPQLLSIIQIIKRMIKSIRYKKILILG TABLE 14-continued Sequences disclosed herein.

```
LLCSLIAGATNPVFSYTFSFLLEGIVPSTDGKTGSSHYLAKWSLLVLGVAAADGIFNFAK
GFLLDCCSEYWVMDLRNEVMEKLTRKNMDWFSGENNKASEISALVLNDLRDLRSLVSEFL
SAMTSFVTVSTIGLIWALVSGWKLSLVCISMFPLIIIFSAIYGGILQKCETDYKTSVAQL
ENCLYQIVTNIKTIKCLQAEFHFQLTYHDLKIKMQQIASKRAIATGFGISMTNMIVMCIQ
AIIYYYGLKLVMIHEYTSKEMFTTFTLLLFTIMSCTSLVSQIPDISRGQRAASWIYRILD
EKHNTLEVENNNARTVGIAGHTYHGKEKKPIVSIQNLTFAYPSAPTAFVYKNMNFDMFCG
QTLGIIGESGTGKSTLVLLLTKLYNCEVGKIKIDGTDVNDWNLTSLRKEISVVEQKPLLF
NGTIRDNLTYGLQDEILEIEMYDALKYVGIHDFVISSPQGLDTRIDTTLLSGGQAQRLCI
ARALLRKSKILILDECTSALDSVSSSIINEIVKKGPPALLTMVITHSEQMMRSCNSIAVL
KDGKVVERGNFDTLYNNRGELFQIVSNQSS
```

SEQ ID NO: 129
YKR039W
>sp|P19145|GAP1_YEAST General amino-acid permease GAP1
OS = *Saccharomyces cerevisiae* (strain ATCC 204508 / S288c) GN = GAP1
PE = 1 SV = 2

```
MSNTSSYEKNNPDNLKHNGITIDSEFLTQEPITIPSNGSAVSIDETGSGSKWQDFKDSFK
RVKPIEVDPNLSEAEKVAIITAQTPLKHHLKNRHLQMIAIGGAIGTGLLVGSGTALRTGG
PASLLIGWGSTGTMIYAMVMALGELAVIFPISGGFTTYATRFIDESFGYANNFNYMLQWL
VVLPLEIVSASITVNFWGTDPKYRDGFVALFWLAIVIINMFGVKGYGEAEFVFSFIKVIT
VVGFIILGIILNCGGGPTGGYIGGKYWHDPGAFAGDTPGAKFKGVCSVFVTAAFSFAGSE
LVGLAASESVEPRKSVPKAAKQVFWRITLFYILSLLMIGLLVPYNDKSLIGASSVDAAAS
PPFVIAIKTHGIKGLPSVVNVVILIAVLSVGNSAIYACSRTMVALAEQRFLPEIFSYVDRK
GRPLVGIAVTSAFGLIAFVAASKKEGEVFNWLLALSGLSSLFTWGGICICHIRFRKALAA
QGRGLDELSFKSPTGVWGSYWGLFMVIIMFIAQFYVAVFPVGDSPSAEGFFEAYLSFPLV
MVMYIGHKIYKRNWKLFIPAEKMDIDTGRREVDLDLLKQEIAEEKAIMATKPRWYRIWNF
WC
```

SEQ ID NO: 130
YLR411W
>sp|Q06686|CTR3_YEAST Copper transport protein CTR3 OS = *Saccharomyces cerevisiae* (strain ATCC 204508 / S288c) GN = CTR3 PE = 1 SV = 1

```
MNMGGSSSTAAKKATCKISMLWNWYTIDTCFIARSWRNDTKGKFAGSCIGCFALVVAQW
LTRFSRQFDVELLKRQKIKHLASYSPEEYVVKCGEEDAKSDIEELQGFYNEPSWKTTLIS
LQKSFIYSFYVWGPRRLNEPEDDLLKKVLSCCTLITPVDLYPTFLDHMIRVTIFVLQWGL
SYIIMLLFMYYNGYIIISCLIGAIVGRFIFCYEPLGSLGANGSAQGTVSYDKESDDRKCC
L
```

SEQ ID NO: 131
YML038C
>sp|Q03697|YMD8_YEAST Putative nucleotide-sugar transporter YMD8
OS = *Saccharomyces cerevisiae* (strain ATCC 204508 / S288c) GN = YMD8
PE = 1 SV = 1

```
MNRTVFLAFVFGWYFCSIALSIYNRWMFDPKDGLGIGYPVLVTTFHQATLWLLSGIYIKL
RHKPVKNVLRKNNGFNWSFFLKFLLPTAVASAGDIGLSNVSFQYVPLTIYTIIKSSSIAF
VLLFGCIFKLEKFHWKLALSVIIMFVGVALMVFKPSDSTSTKNDQALVIFGSFLVLASSC
LSGLRWVYTQLMLRNNPIQTNTAAAVEESDGALFTENEDNVDNEPVVNLANNKMLENFGE
SKPHPIHTIHQLAPIMGITLLLTSLLVEKPFPGIFSSSIFRLDTSNGGVGTETTVLSIVR
GIVLLILPGFAVFLLTICEFSILEQTPVLTVSIVGIVKELLTVIFGIIILSERLSGFYNW
LGMLIIMADVCYYNYFRYKQDLLQKYHSVSTQDNRNELKGFQDFEQLGSKKIAPYSISVD
LTNQEYELDMIAQNVSRSSQQV
```

SEQ ID NO: 132
YMR166C
>sp|Q03829|YM39_YEAST Uncharacterized mitochondrial carrier YMR166C
OS = *Saccharomyces cerevisiae* (strain ATCC 204508 / S288c) GN = YMR166C
PE-1 SV = 1

```
MNSWNLSSSIPIIHTPHDHPPTSEGTPDQPNNNRKDDKLHKKRGDSDEDLSPIWHCVVSG
GIGGKIGDSAMHSLDTVKTRQQGAPNVKKYRNMISAYRTIWLEEGVRRGLYGGYMAAMLG
SFPSAAIFFGTYEYTKRTMIEDWQINDTITHLSAGFLGDFISSFVYVPSEVLKTRLQLQG
RFNNPFFQSGYNYSNLRNAIKTVIKEEGFRSLFFGYKATLARDLPFSALQFAFYEKFRQL
AFKIEQKDGRDGELSIPNEILTGACAGGLAGIITTPMDVVKTRVQTQQPPSQSNKSYSVT
HPHVTNGRPAALSNSISLSLRTVYQSEGVLGFFSGVGPRFVWTSVQSSIMLLLYQMTLRG
LSNAFPTD
```

SEQ ID NO: 133
YMR279C
>sp|Q03263|YM8M_YEAST Uncharacterized transporter YMR279C
OS = *Saccharomyces cerevisiae* (strain ATCC 204508 / S288c) GN = YMR279C
PE = 1 SV = 1

```
MFSIFKKKTSVQGTDSEIDEKITVKAKDKVVVSTEDEEVTTIVSSTKSTQVTNDSPWQDP
TYFSSFGKELMFIATCMLAQLLNQAGQTHALCIMNVLSKSFNSEANNQAWLMASFPLAAG
SFPILISGRLGDIYGLKKMLIVGYVIVIVWSIISGLSKYSNSDAFFITSRAFQGVGIAFIL
PNIMGLVGHVYKVGSFRKNIVISFIGACAPTGGMFGGLFGGLIVTEDPNQWPWVFYAFGI
ATFLSLLMAWYSIPNNVPTNIHGLSMDWTGSALAIIGLILFNFVWNQAPIVGWDKPYIIV
LLIISVIFLVAFFVYESKYAEVPLLPRAMTKNRHMIMILLAVFLGWGSFGIWTFYYVSFQ
LNLRHYSPVWTGGTYFVFVIFGSMAAFFVAFSIKRLGPALLLCFSLMAFDAGSIMFSVLP
```

TABLE 14-continued

Sequences disclosed herein.

VEQSYWKLNFAMQAILCFGMDLSFPASSIILSDGLPMQYQGMAGSLVNTVINYSASLCLG
MGGTVEHQINKSGNDLLKGYRAAVYLGVGLASLGVVISVTYMLENLWNRHRKSEDRSLEA

SEQ ID NO: 134
YNL003C
>sp|P38921|PET8_YEAST Putative mitochondrial carrier protein PET8
OS = Saccharomyces cerevisiae (strain ATCC 204508 / S288c) GN = PET8
PE = 1 SV = 1
MNTFFLSLLSGAAAGTSTDLVFFPIDTIKTRLQAKGGFFANGGYKGIYRGLGSAVVASAP
GASLFFISYDYMKVKSRPYISKLYSQGSEQLIDTTTHMLSSSIGEICACLVRVPAEVVKQ
RTQVHSTNSSWQTLQSILRNDNKEGLRKNLYRGWSTTIMREIPFICIQFPLYEYLKKTWA
KANGQSQVEPWKGAICGSIAGGIAAATTTPLDFLKTRLMLNKTTASLGSVIIRIYREEGP
AVFFSGVGPRTMWISAGGAIFLGMYETVHSLLSKSFPTAGEMRA SEQ ID NO: 135
YNL268W
>sp|P32487|LYP1_YEAST Lysine-specific permease OS = Saccharomyces
cerevisiae (strain ATCC 204508 / S288c) GN = LYP1 PE = 1 SV = 2
MGRFSNIITSNKWDEKQNNIGEQSMQELPEDQIEHEMEAIDPSNKTTPYSIDEKQYNTKK
KHGSLQGGAIADVNSITNSLTRLQVVSHETDINEDEEEAHYEDKHVKRALKQRHIGMIAL
GGTIGTGLFVGISTPLSNAGPVGSLIAYIFMGTIVYFVTQSLGEMATFIPVISSITVFSK
RFLSPAFGVSNGYMYWFNWAITYAVEVSVIGQVIEYWTDKVPLAAWIAIFWVIITLMNFF
PVKVYGEFEFWVASVKVLAIMGYLIYALIIVCGGSHQGPIGFRYWRNPGAWGPGIISSDK
SEGRFLGWVSSLINAAFTYQGTELVGITAGEAANPRKTVPRAINKVVFRIVLFYIMSLFF
IGLLVPYNDSRLSASSAVIASSPFVISIQNAGTYALPDIFNAVVLITVVSAANSNVYVGS
RVLYSLARTGNAPKQFGYVTRQGVPYLGVVCTAALGLLAFLVVNNNANTAFNWLINISTL
AGLCAWLFISLAHIRFMQALKHRGISRDDLPFKAKLMPYGAyyAAFFVTVIIFIQGFQAF
CPFKVSEFFTSYISLILLAVVFIGCQIYYKCRFIWKLEDIDIDSDRREIEAIIWEDDEPK
NLWEKFWAAVA SEQ ID NO: 136
YNR055C
>sp|P53389|HOL1_YEAST Protein HOL1 OS = Saccharomyces cerevisiae
(strain ATCC 204508 / S288c) GN = HOL1 PE = 1 SV = 1
MDKYTNRDHPDYIPGTFNIYSSQNLENGIIYESKLKKTSSGVVLIPQPSYSPNDPLNWSS
WRKLAHFGLMAFITAFTAATSNDAGAAQDSLNEIYGISYDSMNTGAGVLFLGIGWSTLFL
APFANLYGRKITYIVCTTLGLFGALWFALAKRTSDTIWSQLFVGISESCAEAQVQLSLSD
IFFQHQLGSVLTVYIMCTSIGTFLGPLIAGYISAFTNFRWVGWVAVIISGGLLITIIFGC
EETYFDRGQYMTPLTSCQSGYEDGTTLQNSDNTAVSRRKRHLDAKLSTPGAMGEKGVDLS
ETAEFEVNNEEEVTIPETRELIDGSKEHLKPYPKRVAILTKATNLKGYGFKQYFKYLKIN
LRMFLFPPVWLSGMFWGIQDVFLTFYLTTQESAYYEPPWNYSDFGVAIMNVPTLIGAVIG
CICAGIVSDYFVLWMARHNRGILEAEFRLYFSIATAIIGPAGLLMFGIGTARQWPWQAIY
VGLGFVGFAWGCSGDIAMAYLMDCYPDMVLEGMVCTAIINNTISCIFTFTCSDWLAASGT
ENTYIALAVINFGITAFALPMYYYGKRIRLWTKRWYLQSVNLRDGV SEQ ID NO: 137
YOL158C
>sp|Q08299|ENB1_YEAST Siderophore iron transporter ENB1
OS = Saccharomyces cerevisiae (strain ATCC 204508 / S288c) GN = ENB1
PE = 1 SV = 1
MLETDHSRNDNLDDKSTVCYSEKTDSNVEKSTTSGLRRIDAVNKVLSDYSSFTAFGVTFS
SLKTALLVALFLQGYCTGLGGQISQSIQTYAANSFGKHSQVGSINTVKSIVASVVAVPYA
RISDRFGRIECWIFALVLYTIGEIISAATPTFSGLFAGIVIQQFGYSGFRLLATALTGDL
SGLADRTFAMNIFLIPVIINTWVSGNIVSSVAGNVAPYKWRWGYIFCIIVPISTLILVL
PYVYAQYISWRSGKLPPLKLKEKGQTLRQTLWKFADDINLIGVILFTAFLVLVLLPLTIA
GGATSKWREGHIIAMIVVGGCLGFIFLIWELKFAKNPFIPRVYLGDPTIYVALLMEFVWR
LGLQIELEYLVTVLMVAFGESTLSAQRIAQLYNFLQSCTNIVVGIMLHFYPHPKVFVVAG
SLLGVIGMGLLYKYRVVYDGISGLIGAEIVVGIAGGMIRFPMWTLVHASTTHNEMATVTG
LLMSVYQIGDAVGASIAGAIWTQRLAKELIQRLGSSLGMAIYKSPLNYLKKYPIGSEVRV
QMIESYSKIQRLLIIVSISFAAFNAVLCFFLRGFTVNKKQSLSAEEREKEKLKIKQQSWL
RRVIGY SEQ ID NO: 138
YOR100C
>sp|Q12289|CRC1_YEAST Mitochondrial carnitine carrier
OS = Saccharomyces cerevisiae (strain ATCC 204508 / S288c) GN = CRC1
PE = 1 SV = 1
MSSDTSLSESSLLKEESGSLTKSRPPIKSNPVRENIKSFVAGGVGGVCAVFTGHPFDLIK
VRCQNGQANSTVHAITNIIKEAKTQVKGTLFTNSVKGFYKGVIPPLLGVTPIFAVSFWGY
DVGKKLVTFNNKQGGSNELTMGQMAAAGFISAIPTTLVTAPTERVKVVLQTSSKGSFIQA
AKTIVKEGGIASLFKGSLATLARDGPGSALYFASYEISKNYLNSRQPRQDAGKDEPVNIL
NVCLAGGIAGMSWLAVFPIDTIKTKLQASSTRQNMLSATKEIYLQRGGIKGFFPGLGPA
LLRSFPANAATFLGVEMTHSLFKKYGI TABLE 14-continued Sequences disclosed herein.

SEQ ID NO: 139
YOR153W
>sp|P33302|PDR5_YEAST Pleiotropic ABC efflux transporter of multiple
drugs OS = Saccharomyces cerevisiae (strain ATCC 204508 / S288c)
GN = PDR5 PE = 1 SV = 1
MPEAKLNNNVNDVTSYSSASSSTENAADLHNYNGFDEHTEARIQKLARTLTAQSMQNSTQ
SAPNKSDAQSIFSSGVEGVNPIFSDPEAPGYDPKLDPNSENFSSAAWVKNMAHLSAADPD
FYKPYSLGCAWKNLSASGASADVAYQSTVVNIPYKILKSGLRKFQRSKETNTFQILKPMD
GCLNPGELLVVLGRPGSGCTTLLKSISSNTHGFDLGADTKISYSGYSGDDIKKHFRGEVV
YNAEADVHLPHLTVFETLVTVARLKTPQNRIKGVDRESYANHLAEVAMATYGLSHTRNTK
VGNDIVRGVSGGERKRVSIAEVSICGSKFQCWDNATRGLDSATALEFIRALKTQADISNT
SATVAIYQCSQDAYDLFNKVCVLDDGYQIYYGPADKAKKYFEDMGYVCPSRQTTADFLTS
VTSPSERTLNKDMLKKGIHIPQTPKEMNDYWVKSPNYKELMKEVDQRLLNDDEASREAIK
EAHIAKQSKRARPSSPYTVSYMMQVKYLLIRNMWRLRNNIGFTLFMILGNCSMALILGSM
FFKIMKKGDTSTFYFRGSAMFFAILFNAFSSLLEIFSLYEARPITEKHRTYSLYHPSADA
FASVLSEIPSKLIIAVCFNIIFYFLVDFRRNGGVFFFYLLINIVAVFSMSHLFRCVGSLT
KTLSEAMVPASMLLLALSMYTGFAIPKKKILRWSKWIWYINPLAYLFESLLINEFHGIKF
PCAEYVPRGPAYANISSTESVCTVVGAVPGQDYVLGDDFIRGTYQYYHKDKWRGFGIGMA
YVVFFFFVYLFLCEYNEGAKQKGEILVFPRSIVKRMKKRGVLTEKNANDPENVGERSDLS
SDRKMLQESSEEESDTYGEIGLSKSEAIFHWRNLCYEVQIKAETRRILNNVDGWVKPGTL
TALMGASGAGKTTLLDCLAERVTMGVITGDILVNGIPRDKSFPRSIGYCQQQDLHLKTAT
VRESLRFSAYLRQPAEVSIEEKNRYVEEVIKILEMEKYADAVVGVAGEGLNVEQRKRLTI
GVELTAKPKLLVFLDEPTSGLDSQTAWSICQLMKKLANHGQAILCTIHQPSAILMQEFDR
LLFMQRGGKTVYFGDLGEGCKTMIDYFESHGAHKCPADANPAEWMLEVVGAAPGSHANQD
YYEVWRNSEEYRAVQSELDWMERELPKKGSITAAEDKHEFSQSIIYQTKLVSIRLFQQYW
RSPDYLWSKFILTIFNQLFIGFTFFKAGTSLQGLQNQMLAVFMFTVIFNPILQQYLPSFV
QQRDLYEARERPSRTFSWISFIFAQIFVEVPWNILAGTIAYFIYYPIGFYSNASAAGQL
HERGALFWLFSCAFYVYVGSMGLLVISFNQVAESAANLASLLFTMSLSFCGVMTTPSAMP
RFWIFMYRVSPLTYFIQALLAVGVANVDVKCADYELLEFTPPSGMTCGQYMEPYLQLAKT
GYLTDENATDTCSFCQISTTNDYLANVSFYSERWRNYGIFICYIAFNYIAGVFFYWLAR
VPKKNGKLSKK SEQ ID NO: 140
YOR271C
>sp|Q12029|FSF1_YEAST Probable mitochondrial transport protein FSF1
OS = Saccharomyces cerevisiae (strain ATCC 204508 / S288c) GN = FSF1
PE = 1 SV = 1
MASSVPGPIDLPESRYDLSTYWGRIRHCAEISDPTMLLTTEKDLAHAREIISAYRHGELK
ETTPEFWRAKKQLDSTVHPDTGKTVLLPFRMSSNVLSNLVVTVGMLTPGLGTAGTVFWQW
ANQSLNVAVNSANANKSHPMSTSQLLTNYAAAVTASCGVALGLNNLVPRLKNISPHSKLI
LGRLVPFAAVVSAGIVNVFLMRGNEIRKGISVFDSNGDEVGKSKKAAFMAVGETALSRVI
NATPTMVIPPLILVRLQRGVLKGKSLGVQTLANLGLISVTMFSALPFALGIFPQRQAIHL
NKLEPELHGKKDKDGKPIEKVYFNRGI SEQ ID NO: 141
YOR273C
>sp|Q12256|TPO4_YEAST Polyamine transporter 4 OS = Saccharomyces
cerevisiae (strain ATCC 204508 / S288c) GN = TPO4 PE = 1 SV = 1
MPSSLTKTESNSDPRTNIQQVPKALDKNVTNSGNLDSTSSSTGSITEDEKRSEPNADSNN
MTGGEPIDPRDLDWDGPDDPDNPHNWSSLKKWYTTMTSAFLCLVVTMGSSLYVSSVPELV
ERYHVSQTLALAGLTFYLLGLSTVIGAPLSEVFGRKPVYLFSLPVSMLFTMGVGLSNGHM
RIILPLRFLSGVFASPALSVGSGTILDIFDVDQVSVAMTYFVLSPFLGPVLSPIMAGFAT
EAKGWRWSEWIQLIAGGLILPFIALMPETHKGIILRKRAKKRNIALKKFSREAQKEFLKT
TVTITILRPLKMLVVEPIVFVFSVYVAFIFAILFGFFEAYAVIYRGVYHMSMGISGLPFI
GIGVGLWIGAFFYLYIDRKYLFPKPPAGTQPLTEKERTSKRTTPYRGARDAETGELPVV
PEKFLIACKFGSVALPIGLFWQAWTARSDVHWMAPVAAGVPFGFGLILIFFSVLMYFSTC
YPPLTVASCLAANNLLRYVMSSVFPLFTIQMYTKMKIKWASTLFALVCVVMIPIPWVFEK
WGSKLRHKSQFGYAAMEKEAETEGGIDDVNAVDGELNLTRMTTLRTMETDPSTREKPGER
LSLRRTHTQPVPASFDREDGQHAQNREPISNSLYSAIKDNEDGYSYTEMATDASARMV SEQ ID NO: 142
YOR307C
>sp|P22215|SLY41_YEAST Uncharacterized transporter SLY41
OS = Saccharomyces cerevisiae (strain ATCC 204508 / S288c) GN = SLY41
PE = 1 SV = 2
MIQTQSTAIKRRNSVHKNLFDPSLYQIPEPPRGGFQHQKKEYSKETFSNQVFGYDITSLK
KRFTQLFPSNIQGYLPEVDLRITIICSIWYVTSSISSNLSKAILRTFNHPIALTELQFLV
SAVLCVGFASIVNLFRLPRLKHTKFSKALNSFPDGILPEYLDGNFRSSILHKFLVPSKLV
LMTTFPMGIFQFIGHITSHKAVSMIPVSLVHSVKALSPIITVGYYKFFEHRYYNSMTYYT
LLLLIFGVMTTCWSTHGSKRASDNKSGSSLIGLLFAFISMIIFVAQNIFAKNILTIRRKV
GILPSSSTDDVTSKEGQPSLDKTRFSPLQVDKITILFYCSCIGFSLTLLPFLTGELMHGG
SVINDLTLETVALVAIHGIAHFFQAMLAFQLIGLLSSINYSVANIMKRIVVISVALFWET
KLNFFQVFGVILTIAGLYGYDKWGLSKKDGRQA TABLE 14-continued Sequences disclosed herein.

SEQ ID NO: 143
YOR332W
>sp|P22203|VATE_YEAST V-type proton ATPase subunit E
OS = Saccharomyces cerevisiae (strain ATCC 204508 / S288c) GN = VMA4
PE = 1 SV = 4
MSSAITALTPNQVNDELNKMQAFIRKEAEEKAKEIQLKADQEYEIEKTNIVRNETNNIDG
NFKSKLKKAMLSQQITKSTIANKMRLKVLSAREQSLDGIFEETKEKLSGIANNRDEYKPI
LQSLIVEALLKLLEPKAIVKALERDVDLIESMKDDIMREYGEKAQRAPLEEIVISNDYLN
KDLVSGGVVVSNASDKIEINNTLEERLKLLSEEALPAIRLELYGPSKTRKFFD SEQ ID NO: 144
YOR348C
>sp|P15380|PUT4_YEAST Proline-specific permease OS = Saccharomyces
cerevisiae (strain ATCC 204508 / S288c) GN = PUT4 PE = 1 SV = 2
MVNILPFHKNNRHSAGVVTCADDVSGDGSGGDTKKEEDVVQVTESPSSGSRNNHRSDNEK
DDAIRMEKISKNQSASSNGTIREDLIMDVDLEKSPSVDGDSEPHKLKQGLQSRHVQLIAL
GGAIGTGLLVGTSSTLHTCGPAGLFISYIIISAVIYPIMCALGEMVCFLPGDGSDSAGST
ANLVTRYVDPSLGFATGWNYFYCYVILVAAECTAASGVVEYWTTAVPKGVWITIFLCVVV
ILNFSAVKVYGESEFWPASIKILCIVGLIILSFILFWGGGPNHDRLGFRYWQHPGAFAHH
LTGGSLGNFTDIYTGIIKGAFAFILGPELVCMTSAECADQRRNIAKASRRFVWRLIFFYV
LGTLAISVIVPYNDPTLVNALAQGKPGAGSSPFVIGIQNAGIKVLPHIINGCILTSAWSA
ANAFMFASTRSLLTMAQTGQAPKCLGRINKWGVPYVAVGVSFLCSCLAYLNVSSSTADVF
NWFSNISTISGFLGWMCGCIAYLRFRKAIFYNGLYDRLPFKTWGQPYTVWFSLIVIGIIT
ITNGYAIFIPKYWRVADFIAAYITLPIFLVLWFGHKLYTRTWRQWWLPVSEIDVTTGLVE
IEEKSREIEEMRLPPTGFKDKFLDALL SEQ ID NO: 145
YPL036W
>sp|P19657|PMA2_YEAST Plasma membrane ATPase 2 OS = Saccharomyces
cerevisiae (strain ATCC 204508 / S288c) GN = PMA2 PE = 1 SV = 3
MSSTEAKQYKEKPSKEYLHASDGDDPANNSAASSSSSSSTSTSASSSAAAVPRKAAAASA
ADDSDSDEDIDQLIDELQSNYGEGDESGEEEVRTDGVHAGQRVVPEKDLSTDPXYGLTSD
EVARRRKKYGLNQMAEENESLIVKFLMFFVGPIQFVMEAAAILAAGLSDWVDVGVICALL
LLNASVGFIQEFQAGSIVDELKKTLANTATVIRDGQLIEIPANEVVPGEILQLESGTIAP
ADGRIVTEDCFLQIDQSAITGESLAAEKHYGDEVFSSSTVKTGEAFMVVTATGDNTFVGR
AAALVGQASGVEGHFTEVLNGIGIILLVLVIATLLLVWTACFYRTVGIVSILRYTLGITI
IGVPVGLPAVVTTTMAVGAAYLAKKQAIVQKLSAIESLAGVEILCSDKTGTLTKNKLSLH
EPYTVEGVSPDDLMLTACLAASRKKKGLDAIDKAFLKSLIEYPKAKDALTKYKVLEFHPF
DPVSKKVTAVVESPEGERIVCVKGAPLFVLKTVEEDHPIPEDVHENYENKVAELASRGFR
ALGVARKRGEGHWEILGVMPCMDPPRDDTAQTINEARNLGLRIKMLTGDAVGIAKETCRQ
LGLGTNIYNAERLGLGGGGDMPGSELADFVENADGFAEVFPQHKYRVVEILQNRGYLVAM
TGDGVNDAPSLKKADTGIAVEGATDAARSAADIVFLAPGLSAIIDALKTSRQIFHRMYSY
VVYRIALSLHLEIFLGLWIAILNNSLDINLIVFIAIFADVATLTIAYDNAPYAPEPVKWN
LPRLWGMSIILGIVLAIGSWITLTTMFLPNGGIIQNFGAMNGVMFLQISLTENWLIFVTR
AAGPFWSSIPSWQLAGAVFAVDIIATMFTLFGWWSENWTDIVSVVRVWIWSIGIFCVLGG
FYYIMSTSQAFDRLMNGKSLKEKKSTRSVEDFMAAMQRVSTQHEKSS SEQ ID NO: 146
YDL198C
MPHTDKKQSG LARLLGSASA GIMEIAVFHP VDTISKRLMS NHTKITSGQE LNRVIFRDHF
SEPLGKRLFT LFPGLGYAAS YKVLQRVYKY GGQPFANEFL NKHYKKDFDN LFGEKTGKAM
RSAAAGSLIG IGEIVLLPLD VLKIKRQTNP ESFKGRGFIK ILRDEGLFNL YRGWGWTAAR
NAPGSFALFG GNAFAKEYIL GLKDYSQATW SQNFISSIVG ACSSLIVSAP LDVIKTRIQN
PESGL RIVKNTLKNE GVTAFFKGLT PKLLTTGPKL VFSFALAQSL IPRFDNLLSK SEQ ID NO: 147
YFL054C
MSYESGRSSS SSESTRPPTL KEEPNGKIAW EESVKKSREN NENDSTLLRR KLGETRKAIE
TGGSSRNKLS ALTPLKKVVD ERKDSVQPQV PSMGFTYSLP NLKTLNSFSD AEQARIMQDY
LSRGVNQGNS NNYVDPLYRQ LNPTMGSSRN RPVWSLNQPL PHVLDRGLAA KMIQKNMDAR
SRASSRRGST DISRGGSTTS VKDWKRLLRG AAPGKKLGDI EAQTQRDNTV GADVKPTKLE
PENPQKPSNT HIENVSRKKK RTSHNVNFSL GDESYASSIA DAESRKLKNM QTLDGSTPVY
TKLPEELIEE ENKSTSALDG NEIGASEDED ADIMTFPNFW AKIRYHMREP FAEFLGTLVL
VIFGVGGNLQ ATVTKGSGGS YESLSFAWGF GCMLGVYVAG GISGGHINPA VTISMAIFRK
FPWKKVPVYI VAQIIGAYFG GAMAYGYFWS SITEFEGGPH IRTTATGACL FTDPKSYVTW
RNAFFDEFIG ASILVGCLMA LLDDSNAPPG NGMTALIIGF LVAAIGMALG YQTSFTINPA
RDLGPRIFAS MIGYGPHAPH LTHWWWTWGA WGGPIAGGIA GALIYDIFIF TGCESPVNYP
DNGYIENRVG KLLHAEFHQN DGTVSDESGV NSNSNTGSKK SVPTSS SEQ ID NO: 148
Oryza sativa sequence encoding EUGT11
MDSGYSSSYA AAAGMHVVIC PWLAFGHLLP CLDLAQRLAS RGHRVSFVST PRNISRLPPV
RPALAPLVAF VALPLPRVEG LPDGAESTND VPHDRPDMVE LHRRAFDGLA APFSEFLGTA
CADWVIVDVF HHWAAAAALE HKVPCAMMLL GSAHMIASIA DRRLERAETE SPAAAGQGRP
AAAPTFEVAR MKLIRTKGSS GMSLAERFSL TLSRSSLVVG RSCVEFEPET VPLLSTLRGK
PITFLGLMPP LHEGRREDGE DATVRWLDAQ PAKSVVYVAL GSEVPLGVEK VHELALGLEL
AGTRFLWALR KPTGVSDADL LPAGFEERTR GRGVVATRWV PQMSILAHAA VGAFLTHCGW TABLE 14-continued Sequences disclosed herein.

```
NSTIEGLMFG HPLIMLPIFG DQGPNARLIE AKNAGLQVAR NDGDGSFDRE GVAAAIRAVA
VEEESSKVFQ AKAKKLQEIV ADMACHERYI DGFIQQLRSY KD

SEQ ID NO: 149
Synechococcus sp. GGPPS
MVAQTFNLDT YLSQRQQQVE EALSAALVPA YPERIYEAMR YSLLAGGKRL RPILCLAACE
LAGGSVEQAM PTACALEMIH TMSLIHDDLP AMDNDDFRRG KPTNHKVFGE DIAILAGDAL
LAYAFEHIAS QTRGVPPQLV LQVIARIGHA VAATGLVGGQ VVDLESEGKA ISLETLEYIH
SHKTGALLEA SVVSGGILAG ADEELLARLS HYARDIGLAF QIVDDILDVT ATSEQLGKTA
GKDQAAAKAT YPSLLGLEAS RQKAEELIQS AKEALRPYGS QAEPLLALAD FITRRQH SEQ ID NO: 150
Zea mays truncated COPS
MAQHTSESAA VAKGSSLTPI VRTDAESRRT RWPTDDDDAE PLVDEIRAML TSMSDGDISV
SAYDTAWVGL VPRLDGGEGP QFPAAVRWIR NNQLPDGSWG DAALFSAYDR LINTLACVVT
LTRWSLEPEM RGRGLSFLGR NMWKLATEDE ESMPIGFELA FPSLIELAKS LGVHDFPYDH
QALQGIYSSR EIKMKRIPKE VMHTVPTSIL HSLEGMPGLD WAKLLLKLQSS DGSFLFSPAA
TAYALMNTGD DRCFSYIDRT VKKFNGGVPN VYPVDLFEHI WAVDRLERLG ISRYFQKEIE
QCMDYVNRHW TEDGICWARN SDVKEVDDTA MAFRLLRLHG YSVSPDVFKN FEKDGEFFAF
VGQSNQAVTG MYNLNRASQI SFPGEDVLHR AGAFSYEFLR RKEAEGALRD KWIISKDLPG
EVVYTLDFPW YGNLPRVEAR DYLEQYGGGD DVWIGKTLYR MPLVNNDVYL ELARMDFNHC
QALHQLEWQG LKRWYTENRL MDFGVAQEDA LRAYFLAAAS VYEPCRAAER LAWARAAILA
NAVSTHLRNS PSFRERLEHS LRCRPSEETD GSWFNSSSGS DAVLVKAVLR LTDSLAREAQ
PIHGGDPEDI IHKLLRSAWA EWVREKADAA DSVCNGSSAV EQEGSRMVHD KQTCLLLARM
IEISAGRAAG EAASEDGDRR IIQLTGSICD SLKQKMLVSQ DPEKNEEMMS HVDDELKLRI
REFVQYLLRL GEKKTGSSET RQTFLSIVKS CYYAAHCPPH VVDRHISRVI FEPVSAAK SEQ ID NO: 151
Arabidopsis thaliana KS (similar to GenBank AEE36246.1)
MSINLRSSGC SSPISATLER GLDSEVQTRA NNVSFEQTKE KIRKMLEKVE LSVSAYDTSW
VAMVPSPSSQ NAPLFPQCVK WLLDNQHEDG SWGLDNHDHQ SLKKDVLSST LASILALKKW
GIGERQINKG LQFIELNSAL VTDETIQKPT GFDIIFPGMI KYARDLNLTI PLGSEVVDDM
IRKRDLDLKC DSEKFSKGRE AYLAYVLEGT RNLKDWDLIV KYQRKNGSLF DSPATTAAAF
TQFGNDGCLR YLCSLLQKFE AAVPSVYPFD QYARLSIIVT LESLGIDRDF KTEIKSILDE
TYRYWLRGDE EICLDLATCA LAFRLLLAHG YDVSYDPLKP FAEESGFSDT LEGYVKNTFS
VLELFKAAQS YPHESALKKQ CCWTKQYLEM ELSSWVKTSV RDKYLKKEVE DALAFPSYAS
LERSDHRRKI LNGSAVENTR VTKTSYRLHN ICTSDILKLA VDDFNFCQSI HREEMERLDR
WIVENRLQEL KFARQKLAYC YFSGAATLFS PELSDARISW AKGGVLTTVV DDFFDVGGSK
EELENLIHLV EKWDLNGVPE YSSEHVEIIF SVLRDTILET GDKAFTYQGR NVTHHIVKIW
LDLLKSMLRE AEWSSDKSTP SLEDYMENAY ISFALGPIVL PATYLIGPPL PEKTVDSHQY
NQLYKLVSTM GRLLNDIQGF KRESAEGKLN AVSLHMKHER DNRSKEVIIE SMKGLAERKR
EELHKLVLEE KGSVVPRECK EAFLKMSKVL NLFYRKDDGF TSNDLMSLVK SVIYEPVSLQ
KESLT SEQ ID NO: 152
S. rebaudiana KO1
MDAVTGLLTV PATAITIGGT AVALAVALIF WYLKSYTSAR RSQSNHLPRV PEVPGVPLLG
NLLQLKEKKP YMTFTRWAAT YGPIYSIKTG ATSMVVVSSN EIAKEALVTR FQSISTRNLS
KALKVLTADK TMVAMSDYDD YHKTVKRHIL TAVLGPNAQK KHRIHRDIMM DNISTQLHEF
VKNNPEQEEV DLRKIFQSEL FGLAMRQALG KDVESLYVED LKITMNRDEI FQVLVVDPMM
GAIDVDWRDF FPYLKWVPNK KFENTIQQMY IRREAVMKSL IKEHKKRIAS GEKLNSYIDY
LLSEAQTLTD QQLLMSLWEP IIESSDTTMV TTEWAMYELA KNPKLQDRLY RDIKSVCGSE
KITEEHLSQL PYITAIFHET LRRHSPVPII PLRHVHEDTV LGGYHVPAGT ELAVNIYGCN
MDKNVWENPE EWNPERFMKE NETIDFQKTM AFGGGKRVCA GSLQALLTAS IGIGRMVQEF
EWKLKDMTQE EVNTIGLTTQ MLRPLRAIIK PRI SEQ ID NO: 153
A. thaliana ATR2
MSSSSSSTS MIDLMAAIIK GEPVIVSDPA NASAYESVAA ELSSMLIENR QFAMIVTTSI
AVLIGCIVML VWRRSGSGNS KRVEPLKPLV IKPREEEIDD GRKKVTIFFG TQTGTAEGFA
KALGEEAKAR YEKTRFKIVD LDDYAADDDE YEEKLKKEDV AFFFLATYGD GEPTDNAARF
YKWFTEGNDR GEWLKNLKYG VFGLGNRQYE HFNKVAKVVD DILVEQGAQR LVQVGLGDDD
QCIEDDFTAW REALWPELDT ILREEGDTAV ATPYTAAVLE YRVSIHDSED AKFNDITLAN
GNGYTVFDAQ HPYKANVAVK RELHTPESDR SCIHLEFDIA GSGLTMKLGD HVGVLCDNLS
ETVDEALRLL DMSPDTYFSL HAEKEDGTPI SSSLPPPFPP CNLRTALTRY ACLLSSPKKS
ALVALAAHAS DPTEAERLKH LASPAGKDEY SKWVVESQRS LLEVMAEFPS AKPPLGVFFA
GVAPRLQPRF YSISSSPKIA ETRIHVTCAL VYEKMPTGRI HKGVCSTWMK NAVPYEKSEK
LFLGRPIFVR QSNFKLPSDS KVPIIMIGPG TGLAPFRGFL QERLALVESG VELGPSVLFF
GCRNRRMDFI YEEELQRFVE SGALAELSVA FSREGPTKEY VQHKMMDKAS DIWNMISQGA
YLYVCGDAKG MARDVHRSLH TIAQEQGSMD STKAEGFVKN LQTSGRYLRD VW SEQ ID NO: 154
Stevia rebaudiana KAHe1
MEASYLYISI LLLLASYLFT TQLRRKSANL PPTVFPSIPI IGHLYLLKKP LYRTLAKIAA
KYGPILQLQL GYRRVLVISS PSAAEECFTN DVIFANRPK TLFGKIVGGT SLGSLSYGDQ
WRNLRRVASI EILSVHRLNE FHDIRVDENR LLIRKLRSSS SPVTLITVFY ALTLNVIMRM
ISGKRYFDSG DRELEEEGKR FREILDETLL LAGASNVGDY LPILNWLGVK SLEKKLIALQ
KKRDDFFQGL IEQVRKSRGA KVGKGRKTMI ELLLSLQESE PEYYTDAMIR SFVLGLLAAG
```

TABLE 14-continued

Sequences disclosed herein.

```
SDTSAGTMEW AMSLLVNHPH VLKKAQAEID RVIGNNRLID ESDIGNIPYI GCIINETLRL
YPAGPLLFPH ESSADCVISG YNIPRGTMLI VNQWAIHHDP KVWDDPETFK PERFQGLEGT
RDGFKLMPFG SGRRGCPGEG LAIRLLGMTL GSVIQCFDWE RVGDEMVDMT EGLGVTLPKA
VPLVAKCKPR SEMTNLLSEL

SEQ ID NO: 155
Stevia rebaudiana CPRS
MQSNSVKISP LDLVTALFSG KVLDTSNASE SGESAMLPTI AMIMENRELL MILTTSVAVL
IGCVVVLVWR RSSTKKSALE PPVIVVPKRV QEEEVDDGKK KVTVFFGTQT GTAEGFAKAL
VEEAKARYEK AVFKVIDLDD YAADDDEYEE KLKKESLAFF FLATYGDGEP TDNAARFYKW
FTEGDAKGEW LNKLQYGVFG LGNRQYEHFN KIAKVVDDGL VEQGAKRLVP VGLGDDDQCI
EDDFTAWKEL VWPELDQLLR DEDDTTVATP YTAAVAEYRV VFHEKPDALS EDYSYTNGHA
VHDAQHPCRS NVAVKKELHS PESDRSCTHL EFDISNTGLS YETGDHVGVY CENLSEVVND
AERLVGLPPD TYSSIHTDSE DGSPLGGASL PPPFPPCTLR KALTCYADVL SSPKKSALLA
LAAHATDPSE ADRLKFLASP AGKDEYSQWI VASQRSLLEV MEAFPSAKPS LGVFFASVAP
RLQPRYYSIS SSPKMAPDRI HVTCALVYEK TPAGRIHKGV CSTWMKNAVP MTESQDCSWA
PIYVRTSNFR LPSDPKVPVI MIGPGTGLAP FRGFLQERLA LKEAGTDLGL SILFFGCRNR
KVDFIYENEL NNFVETGALS ELIVAFSREG PTKEYVQHKM SEKASDIWNL LSEGAYLYVC
GDAKGMAKDV HRTLHTIVQE QGSLDSSKAE LYVKNLQMSG RYLRDVW SEQ ID NO: 156
Stevia rebaudiana UGT85C2
MDAMATTEKK PHVIFIPFPA QSHIKAMLKL AQLLHHKGLQ ITFVNTDFIH NQFLESSGPH
CLDGAPGFRF ETIPDGVSHS PEASIPIRES LLRSIETNFL DRFIDLVTKL PDPPTCIISD
GFLSVFTIDA AKKLGIPVMM YWTLAACGFM GFYHIHSLIE KGFAPLKDAS YLTNGYLDTV
IDWVPGMEGI RLKDFPLDWS TDLNDKVLMF TTEAPQRSHK VSHHIFHTFD ELEPSIIKTL
SLRYNHIYTI GPLQLLLDQI PEEKKQTGIT SLHGYSLVKE EPECFQWLQS KEPNSVYVN
FGSTTVMSLE DMTEFGWGLA NSNHYFLWII RSNLVIGENA VLPPELEEHI KKRGFIASWC
SQEKVLKHPS VGGFLTHCGW GSTIESLSAG VPMICWPYSW DQLTNCRYIC KEWEVGLEMG
TKVKRDEVKR LVQELMGEGG HKMRNKAKDW KEKARIAIAP NGSSSLNIDK MVKEITVLAR
N SEQ ID NO: 157
S. rebaudiana UGT74G1 (GenBank AAR06920.1)
MAEQQKIKKS PHVLLIPFPL QGHINPFIQF GKRLISKGVK TTLVTTIHTL NSTLNHSNTT
TTSIEIQAIS DGCDEGGFMS AGESYLETFK QVGSKSLADL IKKLQSEGTT IDAIIYDSMT
EWVLDVAIEF GIDGGSFFTQ ACVVNSLYYH VHKGLISLPL GETVSVPGFP VLQRWETPLI
LQNHEQIQSP WSQMLFGQFA NIDQARWVFT NSFYKLEEEV IEWTRKIWNL KVIGPTLPSM
YLDKRLDDDK DNGFNLYKAN HHECMNWLDD KPKESVVYVA FGSLVKHGPE QVEEITRALI
DSDVNFLWVI KHKEEGKLPE NLSEVIKTGK GLIVAWCKQL DVLAHESVGC FVTHCGFNST
LEAISLGVPV VAMPQFSDQT TNAKLLDEIL GVGVRVKADE NGIVRRGNLA SC:KMIMEEE
RGVIIRKNAV KWKDLAKVAV HEGGSSDNDI VEFVSELIKA SEQ ID NO: 158
S. rebaudiana UGT76G1
MENKTETTVR RRRRIILFPV PFQGHINPIL QLANVLYSKG FSITIFHTNF NKPKTSNYPH
FTFRFILDND PQDERISNLP THGPLAGMRI PIINEHGADE LRRELELLML ASEEDEEVSC
LITDALWYFA QSVADSLNLR RLVLMTSSLF NFHAHVSLPQ FDELGYLDPD DKTRLEEQAS
GFPMLKVKDI KSAYSNWQIL KEILGKMIKQ TKASSGVIWN SFKELEESEL ETVIREIPAP
SFLIPLPKHL TASSSSLLDH DRTVFQWLDQ QPPSSVLYVS FGSTSEVDEK DFLEIARGLV
DSKQSFLWVV RPGFVKGSTW VEPLPDGFLG ERGRIVKWVP QQEVLAHGAI GAFWTHSGWN
STLESVCEGV PMIFSDFGLD QPLNARYMSD VLKVGVYLEN GWERGEIANA IRRVMVDEEG
EYIRQNARVL KQKADVSLMK GGSSYESLES LVSYISSL SEQ ID NO: 159
S. rebaudiana UGT91D2e-b
MATSDSIVDD RKQLHVATFP WLAFGHILPY LQLSKLIAEK GHKVSFLSTT RNIQRLSSHI
SPLINVQLT LPRVQELPED AEATTVDHPE DIPYLKKASD GLQPEVTRFL EQHSPDWIIY
DYTHYWLPSI AASLGISRAH FSVTTPWAIA YMGPSADAMI NGSDGRTTVE DLTTPPKWFP
FPTKVCWRKH DLARLVPYKA PGISDGYRMG MVLKGSDCLL SKCYHEFGTQ WLPLLETLHQ
VPVVPVGLLP PEIPGDEKDE TWVSIKKWLD GKQKGSVVYV ALGSEALVSQ TEVVELALGL
ELSGLPFVWA YRKPKGPAKS DSVELPDGFV ERTRDRGLVW TSWAPQLRIL SHESVCGFLT
HCGSGSIVEG LMFGHPLIML PIFGDQPLNA RLLEDKQVGI EIPRNEEDGC LTKESVARSL
RSVVVEKEGE IYKANARELS KIYNDTKVEK EYVSQFVDYL EKNARAVAID HES SEQ ID NO: 160
atggctacct tgttggaaca ttttcaagct atgccattcg ctattccaat tgctttggct
gctttgtctt ggttgttttt gttctacatc aaggtttctt tcttctccaa caaatccgct
caagctaaat tgccaccagt tccagttgtt ccaggtttgc cagttattgg taatttgttg
caattgaaag aaaagaagcc ataccaaacc ttcactagat gggctgaaga atatggtcca
atctactcta ttagaactgg tgcttctact atggttgtct tgaacactac tcaagttgcc
aaagaagcta tggttaccag atacttgtct atctctacca gaaagttgtc caacgccttg
aaaattttga ccgctgataa gtgcatggtt gccatttgtg attacaacga tttccacaag
atgatcaaga gatatatctt gtctaacgtt ttgggtccat ctgcccaaaa aagacataga
tctaacagag atacctgag agccaacgtt tgttctagat gcattccca agttaagaac
tctccaagag aagctgtcaa ctttagaaga gttttcgaat gggaattatt cggtatcgct
ttgaaacaag ccttcggtaa ggatattgaa agccaatct acgtcgaaga attgggtact
actttgtcca gagatgaaat cttccaaggt ttggtcttgg acattatgga aggtgccatt
```

TABLE 14-continued

Sequences disclosed herein.

```
gaagttgatt ggagagattt tttcccatac ttgcgttgga ttccaaacac cagaatggaa
actaagatcc aaagattata cttagaaga aaggccgtta tgaccgcctt gattaacgaa
caaaagaaaa gaattgcctc cggtgaagaa atcaactgct acatcgattt cttgttgaaa
gaaggtaaga ccttgaccat ggaccaaatc tctatgttgt tgtgggaaac cgttattgaa
actgctgata ccacaatggt tactactgaa tgggctatgt acgaagttgc taaggattct
aaaagacaag acagattata ccaagaaatc caaaaggtct gcggttctga aatggttaca
gaagaatact tgtcccaatt gccatacttg aatgctgttt tccacgaaac tttgagaaaa
cattctccag ctgctttggt tccattgaga tatgctcatg aagatactca attgggtggt
tattacattc cagccggtac tgaaattgcc attaacatct acggttgcaa catggacaaa
caccaatggg aatctccaga agaatggaag ccagaaagat ttttggatcc taagtttgac
ccaatggact tgtacaaaac tatggctttt ggtgctggta aaagagtttg cgctggttct
ttacaagcta tgttgattgc ttgtccaacc atcggtagat tggttcaaga atttgaatgg
aagttgagag atggtgaaga agaaaacgtt gatactgttg gtttgaccac ccataagaga
tatccaatgc atgctatttt gaagccaaga tcttaa
```

SEQ ID NO: 161
MATLLEHFQA MPFAIPIALA ALSWLFLFYI KVSFFSNKSA QAKLPPVPVV PGLPVIGNLL
QLKEKKPYQT FTRWAEEYGP IYSIRTGAST MVVLNTTQVA KEAMVTRYLS ISTRKLSNAL
KILTADKCMV AISDYNDFHK MIKRYILSNV LGPSAQKRHR SNRDTLRANV CSRLHSQVKN
SPREAVNFRR VFEWELFGIA LKQAFGKDIE KPIYVEELGT TLSRDEIFKV LVLDIMEGAI
EVDWRDFFPY LRWIPNTRME TKIQRLYFRR KAVMTALINE QKKRIASGEE INCYIDFLLK
EGKTLTMDQI SMLLWETVIE TADTTMVTTE WAMYEVAKDS KRQDRLYQEI QKVCGSEMVT
EEYLSQLPYL NAVFHETLRK HSPAALVPLR YAHEDTQLGG YYIPAGTEIA INIYGCNMDK
HQWESPEEWK PERFLDPKFD PMDLYKTMAF GAGKRVCAGS LQAMLIACPT IGRLVQEFEW
KLRDGEEENV DTVGLTTHKR YPMHAILKPR S

Having described the invention in detail and by reference to specific embodiments thereof, it will be apparent that modifications and variations are possible without departing from the scope of the invention defined in the appended claims. More specifically, although some aspects of the present invention are identified herein as particularly advantageous, it is contemplated that the present invention is not necessarily limited to these particular aspects of the invention.

SEQUENCE LISTING (161 sequences)

SEQ ID NO: 1 - DNA, 894 bp, Synechococcus sp.
atggtcgcacaaactttcaacctggatacctacttatcccaaagacaacaacaagttgaagaggccctaagtgctgctcttgtgccagcttatcctgagagaatatacgaagctatgagatactccctcctggcaggtggcaaaagattaagacctatcttatgtttagctgcttgcgaattggcaggtggttctgttgaacaagccatgccaactgcgtgtgcacttgaaatgatccatacaatgtcactaattcatgatgacctgccagccatggataacgatgatttcagaagaggaaagccaactaatcacaaggtgttcggggaagatatagccatcttagcgggtgatgcgcttttagcttacgcttttgaacatattgcttctcaaacaagaggagtaccacctcaattggtgctacaagttattgctagaatcggacacgccgttgctgcaacaggcctcgttggaggccaagtcgtagaccttgaatctgaaggtaaagctatttccttagaaacattggagtatattcactcacataagactggagccttgctggaagcatcagttgtctcaggcggtattctcgcaggggcagatgaagagcttttggccagattgtctcattacgctagagatataggcttggcttttcaaatcgtcgatgatatcctggatgttactgctacatctgaacagttggggaaaaccgctggtaaagaccaggcagccgcaaaggcaacttatccaagtctattgggtttagaagcctctagacagaaagcggaagagttgattcaatctgctaaggaagccttaagaccttacggttcacaagcagagccactcctagcgctggcagacttcatcacacgtcgtcagcattaa

SEQ ID NO: 2 - DNA, 2343 bp, Zea mays
atggcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 3 - DNA, 2358 bp, Arabidopsis thaliana
atgtctattaatttgagatcttccggttgtagctccccaataagcgcaactttggaaaggggtctagactctgaagttcaaacaagagcaaacaatgtatcttttgagcagaccaaagagaagatcaggaaaatgcttgagaaggtcgagttgagcgtgagtgcctatgacactagttgggtagctatggtcccatcaccatccagtcaaaacgcacctcttttcccacagtgcgtcaaatggctacttgataatcaacatgaggacggctcttggggattggataaccacgaccatcagagcttaaagaaagatgtgttgtcatccacattagcctctatcctagctcttaagaaatggggaataggcgaaagacagatcaataagggtctacagttcattgaattaaactctgcactagttaccgatgaaactatacaaaaacctacaggtttcgacatcatttttccaggaatgattaagtacgccagggaccttaatttgaccatacctcttggctcagaagtagtcgacgatatgatcaggaaaagagatctagacttaaagtgtgatagcgagaaattcagcaaaggtagagaggcttatcttgcctatgttcttgaaggaactaggaacttgaaggactgggacttaattgtgaaatatcagagaaagaacggtagtctatttgatagtccagctacaaccgccgcagctttcactcaatttggcaatgacggttgcttgaggtacttatgttcacttttacagaaattcgaggccgcagtgcctagtgtatatccatttgatcaatacgctagattaagcataatcgtcactttagaatcattgggaattgacagagatttcaagactgagataaaaagcatattggatgagacctataggtactggcttagaggtgacgaagaaatttgcctagatttggccacatgtgcacttgcttttaggttgcttttagcccacggctatgacgtgtcatacgatcctctaaagccatttgcagaggaatctggtttcagcgatacccttgagggatatgttaaaaacaccttttccgtattagagcttttcaaggctgcccaaagttaccctcatgagagtgctttgaaaaagcagtgttgctggacaaaacaatatctagaaatggaactaagttcatgggttaaaacaagcgttagggacaagtacttgaaaaaggaagtggaggatgctttggcatttccatcatatgcctctttagaaagaagtgaccacagaaggaaaattcttaatggctcagcagttgaaaacacaagagtaaccaagacctcttacaggttgcataatatatgtacatcagatatcttaaaacttgctgtcgacgatttcaacttttgccaatctattcatagagaggaaatggaaagattggatagatggatagtggagaatagactacaggaattaaagttcgccagacaaaaattggcttactgttactttagtggcgctgccacactattctctccagaattgtctgacgcaaggatctcatgggctaagggaggtgttctaaccacagtagtcgatgacttttttgatgttggcggtagtaaagaagagcttgagaacttaattcacttggtggaaaagtgggatcttaatggagttcctgaatactcttcagagcatgtagaaataattttctctgtcctaagagacactatcttagaaaccggtgataaagcctttacatatcagggcagaaacgttactcaccatattgtgaaaatatggttggacttacttaagagcatgctaagggaggctgaatggtccagtgacaaatcaaccccatctttggaagattacatggagaatgcctatatcagcttcgcattaggtcctattgtattgccagctacataccttataggacctccactacctgaaaagactgtcgactcccaccaatataatcaattatacaaattggttagtaccatgggtagactattaaacgatatccagggctttaagagggaatcagccgagggaaaacttaatgcagtgtctctacatatgaagcatgaaagagacaacagaagcaaagaggttattatagaatccatgaaaggattggctgaaaggaaaagagaggaattacacaaacttgtactagaagagaaaggtagtgtcgttccaagagaatgcaaggaagccttcttaaaaatgtcaaaagtgttgaaccttttttataggaaggatgatggcttcacatctaacgacttgatgagccttgtgaaatccgtcatctacgagcctgtttcacttcaaaaggagagtctaacttga

SEQ ID NO: 4 - DNA, 1542 bp, Stevia rebaudiana
atggatgctgtgacgggtttgttaactgtcccagcaaccgctataactattggtggaactgctgtagcattggcggtagcgctaatcttttggtacctgaaatcctacacatcagctagaagatcccaatcaaatcatcttccaagagtgcctgaagtcccaggtgttccattgttaggaaatctgttacaattgaaggagaaaaagccatacatgacttttacgagatgggcagcgacatatggacctatctatagtatcaaaactggggctacaagtatggttgtggtatcatctaatgagatagccaaggaggcattggtgaccagattccaatccatatctacaaggaacttatctaaagccctgaaagtacttacagcagataagacaatggtcgcaatgtcagattatgatgattatcataaaacagttaagagacacatactgaccgccgtcttgggtcctaatgcacagaaaaagcatagaattcacagagatatcatgatggataacatatctactcaacttcatgaattcgtgaaaaacaacccagaacaggaagaggtagaccttagaaaaatctttcaatctgagttattcggcttagctatgagacaagccttaggaaaggatgttgaaagtttgtacgttgaagacctgaaaatcactatgaatagagacgaaatctttcaagtccttgttgttgatccaatgatgggagcaatcgatgttgattggagagacttctttccatacctaaagtgggtcccaaacaaaaagttcgaaaatactattcaacaaatgtacatcagaagagaagctgttatgaaatctttaatcaaagagcacaaaaagagaatagcgtcaggcgaaaagctaaatagttatatcgattaccttttatctgaagctcaaactttaaccgatcagcaactattgatgtccttgtgggaaccaatcattgaatcttcagatacaacaatggtcacaacagaatgggcaatgtacgaattagctaaaaaccctaaattgcaagataggttgtacagagacattaagtccgtctgtggatctgaaaagataaccgaagagcatctatcacagctgccttacattacagctattttccacgaaacactgagaagacactcaccagttcctatcattcctctaagacatgtacatgaagataccgttctaggcggctaccatgttcctgctggcacagaacttgccgttaacatctacggttgcaacatggacaaaaacgtttgggaaaatccagaggaatggaacccagaaagattcatgaaagagaatgagacaattgattttcaaaagacgatggccttcggtggtggtaagagagtttgtgctggttccttgcaagcccttttaactgcatctattgggattgggagaatggttcaagagttcgaatggaaactgaaggatatgactcaagaggaagtgaacacgataggcctaactacacaaatgttaagaccattgagagctattatcaaacctaggatctaa

SEQ ID NO: 5 - DNA, 2139 bp, Arabidopsis thaliana
atgtcttcctcttcctcttccagtacctctatgattgatttgatggctgctattattaaaggtgaaccagttatcgtctccgacccagcaaatgcctctgcttatgaatcagttgctgcagaattgtcttcaatgttgatcgaaaacagacaattcgccatgatcgtaactacatcaatcgctgttttgatcggttgtattgtcatgttggtatggagaagatccggtagtggtaattctaaaagagtcgaacctttgaaaccattagtaattaagccaagagaagaagaaatagatgacggtagaaagaaagttacaatatttttcggtacccaaactggtacagctgaaggttttgcaaaagccttaggtgaagaagctaaggcaagatacgaaaagactagattcaagatagtcgatttggatgactatgccgctgatgacgatgaatacgaagaaaagttgaagaaagaagatgttgcatttttctttttggcaacctatggtgacggtgaaccaactgacaatgcagccagattctacaaatggtttacagagggtaatgatcgtggtgaatggttgaaaaacttaaagtacggtgttttcggtttgggtaacagacaatacgaacatttcaacaaagttgcaaaggttgtcgacgatattttggtcgaacaaggtgctcaaagattagtccaagtaggtttgggtgacgatgaccaatgtatagaagatgactttactgcctggagagaagctttgtggcctgaattagacacaatcttgagagaagaaggtgacaccgccgttgctaccccatatactgctgcagtattagaatacagagtttccatccatgatagtgaagacgcaaagtttaatgatatcactttggccaatggtaacggttatacagttttcgatgcacaacacccttacaaagctaacgttgcagtcaagagagaattacatacaccagaatccgacagaagttgtatacacttggaatttgatatcgctggttccggtttaaccatgaagttgggtgaccatgtaggtgttttatgcgacaatttgtctgaaactgttgatgaagcattgagattgttggatatgtcccctgacacttattttagtttgcacgctgaaaaagaagatggtacaccaatttccagttctttaccacctccattccctccatgtaacttaagaacagccttgaccagatacgcttgcttgttatcatcccctaaaaagtccgccttggttgctttagccgctcatgctagtgatcctactgaagcagaaagattgaaacacttagcatctccagccggtaaagatgaatattcaaagtgggtagttgaatctcaaagatcattgttagaagttatggcagaatttccatctgccaagcctccattaggtgtcttctttgctggtgtagcacctagattgcaaccaagattctactcaatcagttcttcacctaagatcgctgaaactagaattcatgttacatgtgcattagtctacgaaaagatgccaaccggtagaattcacaagggtgtatgctctacttggatgaaaaatgctgttccttacgaaaaatcagaaaagttgttcttaggtagaccaatcttcgtaagacaatcaaacttcaagttgccttctgattcaaaggttccaataatcatgataggtcctggtacaggtttagccccattcagaggtttcttgcaagaaagattggctttagttgaatctggtgtcgaattaggtccttcagttttgttctttggttgtagaaacagaagaatggatttcatctatgaagaagaattgcaaagattcgtcgaatctggtgcattggccgaattatctgtagctttttcaagagaaggtccaactaaggaatacgttcaacataagatgatggataaggcatccgacatatggaacatgatcagtcaaggtgcttatttgtacgtttgcggtgacgcaaagggtatggccagagatgtccatagatctttgcacacaattgctcaagaacaaggttccatggatagtaccaaagctgaaggtttcgtaaagaacttacaaacttccggtagatacttgagagatgtctggtga

SEQ ID NO: 6 - DNA, 1503 bp, Stevia rebaudiana
atggaagcctcttacctatacatttctattttgcttttactggcatcatacctgttcaccactcaacttagaaggaagagcgctaatctaccaccaaccgtgtttccatcaataccaatcattggacacttatacttactcaaaaagcctctttatagaactttagcaaaaattgccgctaagtacggaccaatactgcaattacaactcggctacagacgtgttctggtgatttcctcaccatcagcagcagaagagtgctttaccaataacgatgtaatcttcgcaaatagacctaagacattgtttggcaaaatagtgggtggaacatcccttggcagtttatcctacggcgatcaatggcgtaatctaaggagagtagcttctatcgaaatcctatcagttcataggttgaacgaatttcatgatatcagagtggatgagaacagattgttaattagaaaacttagaagttcatcttctcctgttactcttataacagtcttttatgctctaacattgaacgtcattatgagaatgatctctggcaaaagatatttcgacagtggggatagagaattggaggaggaaggtaagagatttcgagaaatcttagacgaaacgttgcttctagccggtgcttctaatgttggcgactacttaccaatattgaactggttgggagttaagtctcttgaaaagaaattgatcgctttgcagaaaaagagagatgactttttccagggtttgattgaacaggttagaaaatctcgtggtgctaaagtaggcaaaggtagaaaaacgatgatcgaactcttattatctttgcaagagtcagaacctgagtactatacagatgctatgataagatcttttgtcctaggtctgctggctgcaggtagtgatacttcagcgggcactatggaatgggccatgagcttactggtcaatcacccacatgtattgaagaaagctcaagctgaaatcgatagagttatcggtaataacagattgattgacgagtcagacattggaaatatcccttacatcgggtgtattatcaatgaaactctaagactctatccagcagggccattgttgttcccacatgaaagttctgccgactgcgttatttccggttacaatatacctagaggtacaatgttaatcgtaaaccaatgggcgattcatcacgatcctaaagtctgggatgatcctgaaacctttaaacctgaaagatttcaaggattagaaggaactagagatggtttcaaacttatgccattcggttctgggagaagaggatgtccaggtgaaggtttggcaataaggctgttagggatgacactaggctcagtgatccaatgttttgattgggagagagtaggagatgagatggttgacatgacagaaggtttgggtgtcacacttcctaaggccgttccattagttgccaaatgtaagccacgttccgaaatgactaatctcctatccgaactttaa

SEQ ID NO: 7 - DNA, 2124 bp, Stevia rebaudiana
atgcaatctaactccgtgaagatttcgccgcttgatctggtaactgcgctgtttagcggcaaggttttggacacatcgaacgcatcggaatcgggagaatctgctatgctgccgactatagcgatgattatggagaatcgtgagctgttgatgatactcacaacgtcggttgctgtattgatcggatgcgttgtcgttttggtgtggcggagatcgtctacgaagaagtcggcgttggagccaccggtgattgtggttccgaagagagtgcaagaggaggaagttgatgatggtaagaagaaagttacggttttcttcggcacccaaactggaacagctgaaggcttcgctaaggcacttgttgaggaagctaaagctcgatatgaaaaggctgtctttaaagtaattgatttggatgattatgctgctgatgacgatgagtatgaggagaaactaaagaaagaatctttggcctttttctttttggctacgtatggagatggtgagccaacagataatgctgccagattttataaatggtttactgagggagatgcgaaaggagaatggcttaataagcttcaatatggagtatttggtttgggtaacagacaatatgaacattttaacaagatcgcaaaagtggttgatgatggtcttgtagaacagggtgcaaagcgtcttgttcctgttggacttggagatgatgatcaatgtattgaagatgacttcaccgcatggaaagagttagtatggccggagttggatcaattacttcgtgatgaggatgacacaactgttgctactccatacacagctgctgttgcagaatatcgcgttgtttttcatgaaaaaccagacgcgctttctgaagattatagttatacaaatggccatgctgttcatgatgctcaacatccatgcagatccaacgtggctgtcaaaaaggaacttcatagtcctgaatctgaccggtcttgcactcatcttgaatttgacatctcgaacaccggactatcatatgaaactggggaccatgttggagtttactgtgaaaacttgagtgaagttgtgaatgatgctgaaagattagtaggattaccaccagacacttactcctccatccacactgatagtgaagacgggtcgccacttggcggagcctcattgccgcctcctttcccgccatgcactttaaggaaagcattgacgtgttatgctgatgttttgagttctcccaagaagtcggctttgcttgcactagctgctcatgccaccgatcccagtgaagctgatagattgaaatttcttgcatcccccgccggaaaggatgaatattctcaatggatagttgcaagccaaagaagtctccttgaagtcatggaagcattcccgtcagctaagccttcacttggtgttttctttgcatctgttgccccgcgcttacaaccaagatactactctatttcttcctcacccaagatggcaccggataggattcatgttacatgtgcattagtctatgagaaaacacctgcaggccgcatccacaaaggagtttgttcaacttggatgaagaacgcagtgcctatgaccgagagtcaagattgcagttgggccccaatatacgtccgaacatccaatttcagactaccatctgaccctaaggtcccggttatcatgattggacctggcactggtttggctccttttagaggtttccttcaagagcggttagctttaaaggaagccggaactgacctcggtttatccattttattcttcggatgtaggaatcgcaaagtggatttcatatatgaaaacgagcttaacaactttgtggagactggtgctctttctgagcttattgttgctttctcccgtgaaggcccgactaaggaatatgtgcaacacaagatgagtgagaaggcttcggatatctggaacttgctttctgaaggagcatatttatacgtatgtggtgatgccaaaggcatggccaaagatgtacatcgaaccctccacacaattgtgcaagaacagggatctcttgactcgtcaaaggcagaactctacgtgaagaatctacaaatgtcaggaagatacctccgtgacgtttggtaa

SEQ ID NO: 8 - DNA, 1446 bp, Stevia rebaudiana
atggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 9 - DNA, 1555 bp, Stevia rebaudiana
atggcggaacaacaaaagatcaagaaatcaccacacgttctactcatcccattccctttacaaggccatataaaccctttcatccagtttggcaaacgattaatctccaaaggtgtcaaaacaacacttgttaccaccatccacaccttaaactcaaccctaaaccacagtaacaccaccaccacctccatcgaaatccaagcaatttccgatggttgtgatgaaggcggttttatgagtgcaggagaatcatatttggaaacattcaaacaagttgggtctaaatcactagctgacttaatcaagaagcttcaaagtgaaggaaccacaattgatgcaatcatttatgattctatgactgaatgggttttagatgttgcaattgagtttggaatcgatggtggttcgtttttcactcaagcttgtgttgtaaacagcttatattatcatgttcataagggtttgatttctttgccattgggtgaaactgtttcggttcctggatttccagtgcttcaacggtgggagacaccgttaattttgcagaatcatgagcaaatacagagcccttggtctcagatgttgtttggtcagtttgctaatattgatcaagcacgttgggtcttcacaaatagtttttacaagctcgaggaagaggtaatagagtggacgagaaagatatggaacttgaaggtaatcgggccaacacttccatccatgtaccttgacaaacgacttgatgatgataaagataacggatttaatctctacaaagcaaaccatcatgagtgcatgaactggttagacgataagccaaaggaatcagttgtttacgtagcatttggtagcctggtgaaacatggacccgaacaagtggaagaaatcacacgggctttaatagatagtgatgtcaacttcttgtgggttatcaaacataaagaagagggaaagctcccagaaaatctttcggaagtaataaaaaccggaaagggtttgattgtagcatggtgcaaacaattggatgtgttagcacacgaatcagtaggatgctttgttacacattgtgggttcaactcaactcttgaagcaataagtcttggagtccccgttgttgcaatgcctcaattttcggatcaaactacaaatgccaagcttctagatgaaattttgggtgttggagttagagttaaggctgatgagaatgggatagtgagaagaggaaatcttgcgtcatgtattaagatgattatggaggaggaaagaggagtaataatccgaaagaatgcggtaaaatggaaggatttggctaaagtagccgttcatgaaggtggtagctcagacaatgatattgtcgaatttgtaagtgagctaattaaggcttaaatttttgttgctttgtattttatgtgttatggttttttgatttagatgtattcaattaatattgaatcataactaaattcaagattattgtttgtaatattctttgtcctaaaattttgcgacttaaaacctttagtttataaaaagaaattagaaaatactattgcacgga

SEQ ID NO: 10 - DNA, 1377 bp, Artificial Sequence
  Codon-optimized UGT76G1
atggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 11 - DNA, 1422 bp, Artificial Sequence
  Codon-optimized UGT91D2e-b
atggctacttctgattccatcgttgacgatagaaagcaattgcatgttgctacttttccatggttggctttcggtcatattttgccatacttgcaattgtccaagttgattgctgaaaagggtcacaaggtttcattcttgtctaccaccagaaacatccaaagattgtcctctcatatctccccattgatcaacgttgttcaattgactttgccaagagtccaagaattgccagaagatgctgaagctactactgatgttcatccagaagatatcccttacttgaaaaaggcttccgatggtttacaaccagaagttactagattcttggaacaacattccccagattggatcatctacgattatactcattactggttgccatccattgctgcttcattgggtatttctagagcccatttctctgttactactccatgggctattgcttatatgggtccatctgctgatgctatgattaacggttctgatggtagaactaccgttgaagatttgactactccaccaaagtggtttccatttccaacaaaagtctgttggagaaaacacgatttggctagattggttccatacaaagctccaggtatttctgatggttacagaatgggtatggttttgaaaggttccgattgcttgttgtctaagtgctatcatgaattcggtactcaatggttgcctttgttggaaacattgcatcaagttccagttgttccagtaggtttgttgccaccagaaattccaggtgacgaaaaagacgaaacttgggtttccatcaaaaagtggttggatggtaagcaaaagggttctgttgtttatgttgctttgggttccgaagctttggtttctcaaaccgaagttgttgaattggctttgggtttggaattgtctggtttgccatttgtttgggcttacagaaaacctaaaggtccagctaagtctgattctgttgaattgccagatggtttcgttgaaagaactagagatagaggtttggtttggacttcttgggctccacaattgagaattttgtctcatgaatccgtctgtggtttcttgactcattgtggttctggttctatcgttgaaggtttgatgtttggtcacccattgattatgttgccaatctttggtgaccaaccattgaacgctagattattggaagataagcaagtcggtatcgaaatcccaagaaatgaagaagatggttgcttgaccaaagaatctgttgctagatctttgagatccgttgtcgttgaaaaagaaggtgaaatctacaaggctaacgctagagaattgtccaagatctacaacgataccaaggtcgaaaaagaatacgtttcccaattcgttgactacttggaaaagaatgctagagctgttgccattgatcatgaatcttga

SEQ ID NO: 12 - DNA, 1389 bp, Artificial Sequence
  Codon-optimized EUGT11
atggatagtggctactcctcatcttatgctgctgccgctggtatgcacgttgtgatctgcccttggttggcctttggtcacctgttaccatgtctggatttagcccaaagactggcctcaagaggccatagagtatcatttgtgtctactcctagaaatatctctcgtttaccaccagtcagacctgctctagctcctctagttgcattcgttgctcttccacttccaagagtagaaggattgccagacggcgctgaatctactaatgacgtaccacatgatagacctgacatggtcgaattgcatagaagagcctttgatggattggcagctccattttctgagttcctgggcacagcatgtgcagactgggttatagtcgatgtatttcatcactgggctgctgcagccgcattggaacataaggtgccttgtgctatgatgttgttagggtcagcacacatgatcgcatccatagctgatagaagattggaaagagctgaaacagaatccccagccgcagcaggacaaggtaggccagctgccgccccaacctttgaagtggctagaatgaaattgattcgtactaaaggtagttcagggatgagtcttgctgaaaggttttctctgacattatctagatcatcattagttgtaggtagatcctgcgtcgagttcgaacctgaaacagtacctttactatctactttgagaggcaaacctattactttccttggtctaatgcctccattacatgaaggaaggagagaagatggtgaagatgctactgttaggtggttagatgcccaacctgctaagtctgttgtttacgttgcattgggttctgaggtaccactaggggtggaaaaggtgcatgaattagcattaggacttgagctggccggaacaagattcctttgggctttgagaaaaccaaccggtgtttctgacgccgacttgctaccagctgggttcgaagagagaacaagaggccgtggtgtcgttgctactagatgggtcccacaaatgagtattctagctcatgcagctgtaggggcctttctaacccattgcggttggaactcaacaatagaaggactgatgtttggtcatccacttattatgttaccaatctttggcgatcagggacctaacgcaagattgattgaggcaaagaacgcaggtctgcaggttgcacgtaatgatggtgatggttcctttgatagagaaggcgttgcagctgccatcagagcagtcgccgttgaggaagagtcatctaaagttttccaagctaaggccaaaaaattacaagagattgtggctgacatggcttgtcacgaaagatacatcgatggtttcatccaacaattgagaagttataaagactaa

SEQ ID NO: 13 - protein, 572 aa, Saccharomyces cerevisiae
MGSEPFQKKNLGLQINSQESGTTRSTFHSLEDLGDDVINESWDQVNQKRANIDHDVFHEHPDSSPSLSAQKAKTKEEEVAVKSSNSQSRDPSPDTQAHIPYTYFSKDQRLIIFGIIIFIGFLGPMSGNIYIPALPLLQREYDVSATTINATVSVFMAVFSVGPLFWGALADFGGRKFLYMVSLSLMLIVNILLAAVPVNIAALFVLRIFQAFASSSVISLGAGTVTDVVPPKHRGKAIAYFMMGPNMGPIIAPIVAGLILMKGNYWRWLFGFTSIMTGIALILVTALLPETLRCIVGNGDPKWGDKKDERENNESPFFEGNKISHRRLFPDIGIRKPVNNDAFFQENFPKPPKAGLTLYWKMIKCPPIIITSVSTALLFSSYYAFSVTFSYYLEHDYRFTMLEIGAAYVCPGVAMLLGSQSGGHLSDYLRSRWIKSHPKKKFPAEFRLLLNLIGILLTICGTIGYGWAIFFHYHFVVLLVFSALTAFGMTWCSNTSMTYLTELFPKRAAGTVAVSSFFRNVGAAISSAIILQLCNAMGIGWCFTGLGLCSSISLIGILYLLIFQRKYTAKEF

SEQ ID NO: 14 - protein, 593 aa, Saccharomyces cerevisiae
MYSIVKEIIVDPYKRLKWGFIPVKRQVEDLPDDLNSTEIVTISNSIQSHETAENFITTTSEKDQLHFETSSYSEHKDNVNVTRSYEYRDEADRPWWRFFDEQEYRINEKERSHNKWYSWFKQGTSFKEKKLLIKLDVLLAFYSCIAYWVKYLDTVNINNAYVSGMKEDLGFQGNDLVHTQVMYTVGNIIFQLPFLIYLNKLPLNYVLPSLDLCWSLLTVGAAYVNSVPHLKAIRFFIGAFEAPSYLAYQYLFGSFYKHDEMVRRSAFYYLGQYIGILSAGGIQSAVYSSLNGVNGLEGWRWNFIIDAIVSVVVGLIGFYSLPGDPYNCYSIFLTDDEIRLARKRLKENQTGKSDFETKVFDIKLWKTIFSDWKIYILTLWNIFCWNDSNVSSGAYLLWLKSLKRYSIPKLNQLSMITPGLGMVYLMLTGIIADKLHSRWFAIIFTQVFNIIGNSILAAWDVAEGAKWFAFMLQCFGWAMAPVLYSWQNDICRRDAQTRAITLVTMNIMAQSSTAWISVLVWKTEEAPRYLKGFTFTACSAFCLSIWTFVVLYFYKRDERNNAKKNGIVLYNSKHGVEKPTSKDVETLSVSDEK

SEQ ID NO: 15 - protein, 459 aa, Saccharomyces cerevisiae
MPSNVRSGVLTLLHTACGAGVLAMPFAFKPFGLMPGLITLTFCGICSLCGLLLQTRIAKYVPKSENASFAKLTQLINPSISVVFDFAIAVKCFGVGVSYLIIVGDLVPQIVQSIFYRNDDNMSGSQEHHMFLDRRLYITLIIVFVISPLCFKRSLNSLRYASMIAIVSVAYLSGLIIYHFVNRHQLERGQVYFMVPHGDSQSHSPLTTLPIFVFAYTCHHNMFSVINEQVDKSFKVIRRIPIFAIVLAYFLYIIIGGTGYMTFGENIVGNILTLYPNSISTTIGRLAMLLLVMLAFPLQCHPCRSSVKNIIIFIENFRKGKLYDNRASFIPLDNFNSEDPQEAPTQQNNEEPNLRSESLRHINIITLCILLFSYLLAISITSLAKVLAIVGATGSTSISFILPGLFGYKLIGSEFTGTNERVPTSIKIFKYLSLSLFIWGIAVMVASLSAIVFLGTSSH

SEQ ID NO: 16 - protein, 545 aa, Saccharomyces cerevisiae
MLARTAAIRSLSRTLINSTKAARPAAAALASTRRLASTKAQPTEVSSILEERIKGVSDEANLNETGRVLAVGDGIARVFGLNNIQAEELVEFSSGVKGMALNLEPGQVGIVLFGSDRLVKEGELVKRTGNIVDVPVGPGLLGRVVDALGNPIDGKGPIDAAGRSRAQVKAPGILPRRSVHEPVQTGLKAVDALVPIGRGQRELIIGDRQTGKTAVALDTILNQKRWNNGSDESKKLYCVYVAVGQKRSTVAQLVQTLEQHDAMKYSIIVAATASEAAPLQYLAPFTAASIGEWFRDNGKHALIVYDDLSKQAVAYRQLSLLLRRPPGREAYPGDVFYLHSRLLERAAKLSEKEGSGSLTALPVIETQGGDVSAYIPTNVISITDGQIFLEAELFYKGIRPAINVGLSVSRVGSAAQVKALKQVAGSLKLFLAQYREVAAFAQFGSDLDASTKQTLVRGERLTQLLKQNQYSPLATEEQVPLIYAGVNGHLDGIELSRIGEFESSFLSYLKSNHNELLTEIREKGELSKELLASLKSATESFVATF

SEQ ID NO: 17 - protein, 488 aa, Saccharomyces cerevisiae
MAETERLMPNGGSRETKPLITGHLILGTIVACLGSIQYGYHIAELNAPQEFLSCSRFEAPDENISYDDTWVGQHGLKQCIALTDSQYGAITSIFSIGGLFGSYYAGNWANRYGRKYVSMGASAMCMVSSLLLFFSNSYLQLLFGRFLVGMSCGTAIVITPLFINEIAPVEWRGAMGSMNQVSINLGILLTQTLALKYADSYNWRWLLFSGSVIAVANILAWLKVDESPRWLVSHGFVSEAETALFKLRPGTYQQAKQEIQDWQRSHGHNRDPESSEETHSGPTLWQYVTDPSYKKPRTVILAILSCQQFCGINSIIFYGVKVIGKILPDYSIQVNFAISILNVVVTLAASAIIDHVGRRPLLLASTTVMTAMSLLISVGLTLSVSFLLVTATFVYIAAFAIGLGPIPFLIIGELSYPQDAATAQSFGTVCNWLATFIVGYLFPIGHGLMGGYVFAIFAAIAAMFATYVYKRVPETKGKTTYSEVWAGY

SEQ ID NO: 18 - protein, 859 aa, Saccharomyces cerevisiae
MSRKSSTEYVHNQEDADIEVFESEYRTYRESEAAENRDGLHNGDEENWKVNSSKQKFGVTKNELSDVLYDSIPAYEESTVTLKEYYDHSIKNNLTAKSAGSYLVSLFPIIKWFPHYNFTWGYADLVAGITVGCVLVPQSMSYAQIASLSPEYGLYSSFIGAFIYSLFATSKDVCIGPVAVMSLQTAKVIAEVLKKYPEDQTEVTAPIIATTLCLLCGIVATGLGILRLGFLVELISLNAVAGFMTGSAFNIIWGQIPALMGYNSLVNTREATYKVVINTLKHLPNTKLDAVFGLIPLVILYVWKWWCGTFGITLADRYYRNQPKVANRLKSFYFYAQAMRNAVVIVVFTAISWSITRNKSSKDRPISILGTVPSGLNEVGVMKIPDGLLSNMSSEIPASIIVLVLEHIAISKSFGRINDYKVVPDQELIAIGVTNLIGTFFHSYPATGSFSRSALKAKCNVRTPFSGVFTGGCVLLALYCLTDAFFFIPKATLSAVIIHAVSDLLTSYKTTWTFWKTNPLDCISFIVTVFITVFSSIENGIYFAMCWSCAMLLLKQAFPAGKFLGRVEVAEVLNPTVQEDIDAVISSNELPNELNKQVKSTVEVLPAPEYKFSVKWVPFDHGYSRELNINTTVRPPPPGVIVYRLGDSFTYVNCSRHYDIIFDRIKEETRRGQLITLRKKSDRPWNDPGEWKMPDSLKSLFKFKRHSATTNSDLPISNGSSNGETYEKPLLKVVCLDFSQVAQVDSTAVQSLVDLRKAVNRYADRQVEFHFAGIISPWIKRSLLSVKFGTTNEEYSDDSIIAGHSSFHVAKVLKDDVDYTDEDSRISTSYSNYETLCAATGTNLPFFHIDIPDFSKWDV

SEQ ID NO: 19 - protein, 458 aa, Saccharomyces cerevisiae
MNMLIVGRVVASVGGSGLQTLCFVIGCTMVGERSRPLVISILSCAFAVAAIVGPIIGGAFTTHVTWRWCFYINLPIGGLAIIMFLLTYKAENKGILQQIKDAIGTISSFTFSKFRHQVNFKRLMNGIIFKFDFFGFALCSAGLVLFLLGLTFGGNKYSWNSGQVIAYLVLGVLLFIFSLVYDFFLFDKFNPEPDNISYRPLLLRRLVAKPAIIIINMVTFLLCTGYNGQMIYSVQFFQLIFASSAWKAGLHLIPIVITNVIAAIASGVITKKLGLVKPLLIFGGVLGVIGAGLMTLMTNTSTKSTQIGVLLLPGFSLGFALQASLMSAQLQITKDRPEAAMDFIEVTAFNTFMKSLGTTLGGVLSTTVFSASFHNKVSRAHLEPYEGKTVDDMILYRLQNYDGSHSTIGNILSDSIKNVFWMDLGFYALGFLFCSFSSNKKLIIPKKDETPEDNLEDK

SEQ ID NO: 20 - protein, 512 aa, Saccharomyces cerevisiae
MMKESKSITQHEVERESVSSKRAIKKRLLLFKIDLFVLSFVCLQYWINYVDRVGFTNAYISGMKEDLKMVGNDLTVSNTVFMIGYIVGMVPNNLMLLCVPPRIWLSFCTFAWGLLTLGMYKVTSFKHICAIRFFQALFESCTFSGTHFVLGSWYKEDELPIRSAIFTGSGLVGSMFSGFMQTSIFTHLNGRNGLAGWRWLFIIDFCITLPIAIYGFIFFPGLPDQTSAVSKFSMTRYIFNEQELHYARRRLPARDESTRLDWSTIPRVLKRWHWWMFSLVWVLGGENLGFASNSTFALWLQNQKYTLAQRNNYPSGIFAVGIVSTLCSAVYMSKIPRARHWHVSVFISLVMVIVAVLIRADPLNPKVVFSAQYLGGVAYAGQAVFFSWANIICHADLQERAIVLASMNMFSGAVNAWWSILFFASDMVPKFERGCYALLATAISSGIVSVVIRSLQIKENLSKKQVPYIDANDMPGEDDDDDNQDNENDGDDESMEVELHNEEMAEISNPFR

SEQ ID NO: 21 - protein, 260 aa, Saccharomyces cerevisiae
MVSLDDILGIVYVTSWSISMYPPIITNWRHKSASAISMDFVMLNTAGYSYLVISIFLQLYCWKMTGDESDLGRPKLTQFDFWYCLHGCLMNVVLLTQVVAGARIWRFPGKGHRKMNPWYLRILLASLAIFSLLTVQFMYSNYWYDWHNSRTLAYCNNLFLLKISMSLIKYIPQVTHNSTRKSMDCFPIQGVFLDVTGGIASLLQLIWQLSNDQGFSLDTFVTNFGKVGLSMVTLIFNFIFIMQWFVYRSRGHDLASEYPL

SEQ ID NO: 22 - protein, 411 aa, Saccharomyces cerevisiae
MDATTPLLTVANSHPARNPKHTAWRAAVYDLQYILKASPLNFLLVFVPLGLIWGHFQLSHTLTFLFNFLAIIPLAAILANATEELADKAGNTIGGLLNATFGNAVELIVSIIALKKGQVRIVQASMLGSLLSNLLLVLGLCFIFGGYNRVQQTFNQTAAQTMSSLLAIACASLLIPAAFRATLPHGKEDHFIDGKILELSRGTSIVILIVYVLFLYFQLGSHHALFEQQEEETDEVMSTISRNPHHSLSVKSSLVILLGTTVIISFCADFLVGTIDNVVESTGLSKTFIGLIVIPIVGNAAEHVTSVLVAMKDKMDLALGVAIGSSLQVALFVTPFMVLVGWMIDVPMTLNFSTFETATLFIAVFLSNYLILDGESNWLEGVMSLAMYILIAMAFFYYPDEKTLDSIGNSL

SEQ ID NO: 23 - protein, 1071 aa, Saccharomyces cerevisiae
MAGAIENARKEIKRISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLSTMQERFAESTD

SEQ ID NO: 24 - protein, 884 aa, Saccharomyces cerevisiae
MDPNSNSSSETLRQEKQGFLDKALQRVKGIALRRNNSNKDHTTDDTTGSIRTPTSLQRQNSDRQSNMTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 25 - protein, 571 aa, Saccharomyces cerevisiae
MSMSSKNENKISVEQRISTDIGQAYQLQGLGSNLRSIRSKTGAGEVNYIDAAKSVNDNQLLAEIGYKQELKRQFSTLQVFGIAFSIMGLLPSIASVMGGGLGGGPATLVWGWFVAAFFILLVGITMAEHASSIPTAGGLYYWTYYYAPEGYKEIISFIIGCSNSLALAAGVCSIDYGLAEEIAAAVTLTKDGNFEVTSGKLYGIFAGAVVVMCICTCVASGAIARLQTLSIFANLFIIVLLFIALPIGTKHRMGGFNDGDFIFGKYENLSDWNNGWQFCLAGFMPAVWTIGSFDSCVHQSEEAKDAKKSVPIGIISSIAVCWILGWLIIICLMACINPDIDSVLDSKYGFALAQIIYDSLGKKWAIAFMSLIAFCQFLMGASITTAVSRQVWAFSRDNGLPLSKYIKRVDSKYSVPFFAILAACVGSLILGLLCLIDDAATDALFSLAVAGNNLAWSTPTVFRLTSGRDLFRPGPFYLGKIWSPIVAWTGVAFQLFIIILVMFPSQQHGITKSTMNYACVIGPGIWILAGIYYKVYKKKYYHGPATNLSDDDYTEAVGADVIDTIMSKQEP

SEQ ID NO: 26 - protein, 539 aa, Saccharomyces cerevisiae
MSTNKFVVRITNALFKSSLASNSPPVYPKRIRHFEILPNEKWVIWGPGKGKFLDVLNNKYICEPPLSLRFGFLKESSNILPRIEQVAFKGVMPTAHLSARYEYFKDDYDQTCKQFIFDKASGSNAVSYKVETNNRQINMELYNALVENLNLSSLQDRWVMGLSNGQMRRARLARSILKEPDLLLIDDPFLGLDPAAIATISQFLAKYDSIEVSGGCPIVIGLRYQDTIPAWCTHICCVDEKNGILFEGPIEKLQSKMDETRSRALKELEQLKKASNSKEDISINDLICIHPMYGKKEHEIIKMPHLIELDGLSVSYKGEAVLENLHWKVQPGSKWHIRGDNGSGKSTLLSLLTAEHPQSWNSRVIDNGVPRRTGKTNYFDLNSKIGMSSPELHAIFLKNAGGRLNIRESVATGYHEASSNNYLPIWKRLDKNSQEIVNMYLKYFGLDKDADSVLFEQLSVSDQKLVLFVRSLIKMPQILILDEAFSGMEVEPMMRCHEFLEEWPGTVLVVAHVAEETPKCAHYLRLISPGEYEIGDMEN

SEQ ID NO: 27 - protein, 1612 aa, Saccharomyces cerevisiae
MSSPSKPTSPFVDDIEHESGSASNGLSSMSPFDDSFQFEKPSSAHGNIEVAKTGGSVLKRQSKPMKDISTPDLSKVTFDGIDDYSNDNDINDDDELNGKKTEIHEHENEVDDDLHSFQATPMPNTGGFEDVELDNNEGSNNDSQADHKLKRVRFGTRRNKSGRIDINRSKTLKWAKKNFHNAIDEFSTKEDSLENSALQNRSDELRTVYYNLPLPEDMLDEDGLPLAVYPRNKIRTTKYTPLTFFPKNILFQFHNFANIYFLILLILGAFQIFGVTNPGFASVPLIVIVIITAIKDGIEDSRRTVLDLEVNNTRTHILSGVKNENVAVDNVSLWRRFKKANTRALIKIFEYFSENLTAAGREKKLQKKREELRRKRNSRSFGPRGSLDSIGSYRMSADFGRPSLDYENLNQTMSQANRYNDGENLVDRTLQPNPECRFAKDYWKNVKVGDIVRVHNNDEIPADMILLSTSDVDGACYVETKNLDGETNLKVRQSLKCSKIIKSSRDITRTKFWVESEGPHANLYSYQGNFKWQDTQNGNIRNEPVNINNLLLRGCTLRNTKWAMGMVIFTGDDTKIMINAGVTPTKKSRISRELNFSVILNFVLLFILCFTAGIVNGVYYKQKPRSRDYFEFGTIGGSASTNGFVSFWVAVILYQSLVPISLYISVEIIKTAQAIFIYTDVLLYNAKLDYPCTPKSWNISDDLGQIEYIFSDKTGTLTQNVMEFKKCTINGVSYGRAYTEALAGLRKRQGVDVESEGRREKEEIAKDRETMIDELRSMSDNTQFCPEDLTFVSKEIVEDLKGSSGDHQQKCCEHFLLALALCHSVLVEPNKDDPKKLDIKAQSPDESALVSTARQLGYSFVGSSKSGLIVEIQGVQKEFQVLNVLEFNSSRKRMSCIIKIPGSTPKDEPKALLICKGADSVIYSRLDRTQNDATLLEKTALHLEEYATEGLRTLCLAQRELTWSEYERWVKTYDVAAASVTNREEELDKVTDVIERELILLGGTAIEDRLQDGVPDSIALLAEAGIKLWVLTGDKVETAINIGFSCNVLNNDMELLVVKASGEDVEEFGSDPIQVVNNLVTKYLREKFGMSGSEEELKEAKREHGLPQGNFAVIIDGDALKVALNGEEMRRKFLLLCKNCKAVLCCRVSPAQKAAVVKLVKKTLDVMTLAIGDGSNDVAMIQSADVGVGIAGEEGRQAVMCSDYAIGQFRYVTRLVLVHGKWCYKRLAEMIPQFFYKNVIFTLSLFWYGIYNNFDGSYLFEYTYLTFYNLAFTSVPVILLAVLDQDVSDTVSMLVPQLYRVGILRKEWNQTKFLWYMLDGVYQSVICFFFPYLAYHKNMVVTENGLGLDHRYFVGVFVTAIAVTSCNFYVFMEQYRWDWFCGLFICLSLAVFYGWTGIWTSSSSSNEFYKGAARVFAQPAYWAVLFVGVLFCLLPRFTIDCIRKIFYPKDIEIVREMWLRGDFDLYPQGYDPTDPSRPRINEIRPLTDFKEPISLDTHFDGVSHSQETIVTEEIPMSILNGEQGSRKGYRVSTTLERRDQLSPVTTTNNLPRRSMASARGNKLRTSLDRTREEMLANHQLDTRYSVERARASLDLPGINHAETLLSQRSRDR

SEQ ID NO: 28 - protein, 695 aa, Saccharomyces cerevisiae
MAGILSKTLSEVHPSLRTNGMGIGNTHRRISLGFLPPNKKNPLVRKFRARTRNIDQRSFRSLTDDFGSNVHEPNPYLGNIDEEPDLYYHDEEDGELSRTISLPSRVSETPELSPQDVDWILHEHERRYSSVCNSDNEEASQSNTPDRIQEYSGRELEYDEFMNRLQAQKQKLTRSAVTDAKGTSHHRRPSFVSVTSRGSVPTIYQEIDENDSEALAELAHSHVTFKSEARVLASYSFPLIFTFLLEQIFPMVCSLTVGHLGKNELAAVSLASMTSNITLAIFEGIATSLDTLCPQAYGSGRFYSVGVHLQRCIAFSLVIYIPFAVMWWYSEPLLSYIIPEKELINLTSRFLRVLILGAPAYIFFENLKRFLQAQGIFDAGIYVLTICAPLNVLVSYTLVWNKYIGVGFIGAAIAVVLNFWLMFFLLLFYALYIDGRKCWGGFSRKAFTHWNDLGHLAFSGIIMLEAEELSYELLTLFSAYYGVSYLAAQSAVSTMAALLYMIPFAIGISTSTRIANFIGAKRTDFAHISSQVGLSFSFIAGFINCCILVFGRNLIANIYSKDPEVIKLIAQVLPLVGIVQNFDSLNAVAGSCLRGQGMQSLGSIVNLMAYYLFGIPLALILSWFFDMKLYGLWIGIGSAMLLIGLVEAYYVLFPDWDKIMTYAEILKETEDDEVDSDEYLTDSDDPDENTALLGA

SEQ ID NO: 29 - protein, 1529 aa, Saccharomyces cerevisiae
MSSDIRDVEERNSRSSSSSSSSNSAAQSIGQHPYRGFDSEAAERVHELARTLTSQSLLYTANSNNSSSSNHNAHNADSRSVFSTDMEGVNPVFTNPDTPGYNPKLDPNSDQFSSTAWVQNMANICTSDPDFYKPYSLGCVWKNLSASGDSADVSYQSTFANIVPKLLTKGLRLLKPSKEEDTFQILKPMDGCLNPGELLVVLGRPGSGCTTLLKSISSNSHGFKIAKDSIVSYNGLSSSDIRKHYRGEVVYNAESDIHLPHLTVYQTLFTVARMKTPQNRIKGVDREAYANHVTEVAMATYGLSHTRDTKVGNDLVRGVSGGERKRVSIAEVAICGARFQCWDNATRGLDSATALEFIRALKTQADIGKTAATVAIYQCSQDAYDLFDKVCVLDDGYQLYFGPAKDAKKYFQDMGYYCPPRQTTADFLTSITSPTERIISKEFIEKGTRVPQTPKDMAEYWLQSESYKNLIKDIDSTLEKNTDEARNIIRDAHHAKQAKRAPPSSPYVVNYGMQVKYLLIRNFWRMKQSASVTLWQVIGNSVMAFILGSMFYKVMKKNDTSTFYFRGAAMFFAILFNAFSCLLEIFSLYETRPITEKHRTYSLYHPSADAFASVLSEMPPKLITAVCFNIIFYFLVDFRRNGGVFFFYFLINVIATFTLSHLFRCVGSLTKTLQEAMVPASMLLLAISMYTGFAIPKTKILGWSIWIWYINPLAYLFESLMINEFHDRRFPCAQYIPAGPAYQNITGTQRVCSAVGAYPGNDYVLGDDFLKESYDYEHKHKWRGFGIGMAYVVFFFFVYLILCEYNEGAKQKGEMVVFLRSKIKQLKKEGKLQEKHRPGDIENNAGSSPDSATTEKKILDDSSEGSDSSSDNAGLGLSKSEAIFHWRDLCYDVPIKGGQRRILNNVDGWVKPGTLTALMGASGAGKTTLLDCLAERVTMGVITGNIFVDGRLRDESFPRSIGYCQQQDLHLKTATVRESLRFSAYLRQPSSVSIEEKNRYVEEVIKILEMQQYSDAVVGVAGEGLNVEQRKRLTIGVELAARPKLLVFLDEPTSGLDSQTAWDTCQLMRKLATHGQAILCTIHQPSAILMQQFDRLLFLQKGGQTVYFGDLGEGCKTMIDYFESKGAHKCPPDANPAEWMLEVVGAAPGSHATQDYNEVWRNSDEYKAVQEELDWMEKNLPGRSKEPTAEEHKPFAASLYYQFKMVTIRLFQQYWRSPDYLWSKFILTIFNQVFIGFTFFKADRSLQGLQNQMLSIFMYTVIFNPILQQYLPSFVQQRDLYEARERPSRTFSWLAFFLSQIIVEIPWNILAGTIAYCIYYYAVGFYANASAAGQLHERGALFWLFSIAFYVYIGSMGLLMISFNEVAETAAHMGTLLFTMALSFCGVMATPKVMPRFWIFMYRVSPLTYMIDALLALGVANVDVKCSNYEMVKFTPPSGTTCGDYMASYIKLAGTGYLSDPSATDICSFCAVSTTNAFLATFSSHYYRRWRNYGIFICYIAFDYIAATFLYWLSRVPKKNGKISEKPKK

SEQ ID NO: 30 - protein, 569 aa, Saccharomyces cerevisiae
MKDLKLSNFKGKFISRTSHWGLTGKKLRYFITIASMTGFSLFGYDQGLMASLITGKQFNYEFPATKENGDHDRHATVVQGATTSCYELGCFAGSLFVMFCGERIGRKPLILMGSVITIIGAVISTCAFRGYWALGQFIIGRVVTGVGTGLNTSTIPVWQSEMSKAENRGLLVNLEGSTIAFGTMIAYWIDFGLSYTNSSVQWRFPVSMQIVFALFLLAFMIKLPESPRWLISQSRTEEARYLVGTLDDADPNDEEVITEVAMLHDAVNRTKHEKHSLSSLFSRGRSQNLQRALIAASTQFFQQFTGCNAAIYYSTVLFNKTIKLDYRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKEDFGEDRVEDTYNQINGDNSSSSSNIKNEDTVNDKANFEG

SEQ ID NO: 31 - protein, 1215 aa, Saccharomyces cerevisiae
MTKKSFVSSPIVRDSTLLVPKSLIAKPYVLPFFPLYATFAQLYFQQYDRYIKGPEWTFVYLGTLVSLNILVMLMPAWNVKIKAKFNYSTTKNVNEATHILIYTTPNNGSDGIVEIQRVTEAGSLQTFFQFQKKRFLWHENEQVFSSPKFLVDESPKIGDFQKCKGHSGDLTHLKRLYGENSFDIPIPTFMELFKEHAVAPLFVFQVFCVALWLLDEFWYYSLFNLFMIISMEAAAVFQRLTALKEFRTMGIKPYTINVFRNKKWVALQTNELLPMDLVSITRTAEESAIPCDLILLDGSAIVNEAMLSGESTPLLKESIKLRPSEDNLQLDGVDKIAVLHGGTKALQVTPPEHKSDIPPPPDGGALAIVTKTGFETSQGSLVRVMIYSAERVSVDNKEALMFILFLLIFAVIASWYVWVEGTKMGRIQSKLILDCILIITSVVPPELPMELTMAVNSSLAALAKFYVYCTEPFRIPFAGRIDVCCFDKTGTLTGEDLVFEGLAGISADSENIRHLYSAAEAPESTILVIGAAHALVKLEDGDIVGDPMEKATLKAVGWAVERKNSNYREGTGKLDIIRRFQFSSALKRSASIASHNDALFAAVKGAPETIRERLSDIPKNYDEIYKSFTRSGSRVLALASKSLPKMSQSKIDDLNRDDVESELTFNGFLIFHCPLKDDAIETIKMLNESSHRSIMITGDNPLTAVHVAKEVGIVFGETLILDRAGKSDDNQLLFRDVEETVSIPFDPSKDTFDHSKLFDRYDIAVTGYALNALEGHSQLRDLLRHTWVYARVSPSQKEFLLNTLKDMGYQTLMCGDGTNDVGALKQAHVGIALLNGTEEGLKKLGEQRRLEGMKMMYIKQTEFMARWNQPQPPVPEPIAHLFPPGPKNPHYLKALESKGTVITPEIRKAVEEANSKPVEVIKPNGLSEKKPADLASLLLNSAGDAQGDEAPALKLGDASCAAPFTSKLANVSAVTNIIRQGRCALVNTIQMYKILALNCLISAYSLSIIYMAGVKFGDGQATVSGLLLSVCFLSISRGKPLEKLSKQRPQSGIFNVYIMGSILSQFAVHIATLVYITTEIYKLEPREPQVDLEKEFAPSLLNTGIFIIQLVQQVSTFAVNYQGEPFRENIRSNKGMYYGLLGVTGLALASATEFLPELNEAMKFVPMTDDFKIKLTLTLLLDFFGSWGVEHFFKFFFMDDKPSDISVQQVKIASK

SEQ ID NO: 32 - protein, 1571 aa, Saccharomyces cerevisiae
MSGTFHGDGHAPMSPFEDTFQFEDNSSNEDTHIAPTHFDDGATSNKYSRPQVSFNDETPKNKREDAEEFTFNDDTEYDNHSFQPTPKLNNGSGTFDDVELDNDSGEPHTNYDGMKRFRMGTKRNKKGNPIMGRSKTLKWARKNIPNPFEDFTKDDIDPGAINRAQELRTVYYNMPLPKDMIDEEGNPIMQYPRNKIRTTKYTPLTFLPKNILFQFHNFANVYFLVLIILGAFQIFGVTNPGLSAVPLVVIVIITAIKDAIEDSRRTVLDLEVNNTKTHILEGVENENVSTDNISLWRRFKKANSRLLFKFIQYCKEHLTEEGKKKRMQRKRHELRVQKTVGTSGPRSSLDSIDSYRVSADYGRPSLDYDNLEQGAGEANIVDRSLPPRTDCKFAKNYWKGVKVGDIVRIHNNDEIPADIILLSTSDTDGACYVETKNLDGETNLKVRQSLKCTNTIRTSKDIARTKFWIESEGPHSNLYTYQGNMKWRNLADGEIRNEPITINNVLLRGCTLRNTKWAMGVVMFTGGDTKIMLNSGITPTKKSRISRELNFSVVINFVLLFILCFVSGIANGVYYDKKGRSRFSYEFGTIAGSAATNGFVSFWVAVILYQSLVPISLYISVEIIKTAQAAFIYGDVLLYNAKLDYPCTPKSWNISDDLGQVEYIFSDKTGTLTQNVMEFKKCTINGVSYGRAYTEALAGLRKRQGIDVETEGRREKAEIAKDRDTMIDELRALSGNSQFYPEEVTFVSKEFVRDLKGASGEVQQRCCEHFMLALALCHSVLVEANPDNPKKLDLKAQSPDEAALVATARDVGFSFVGKTKKGLIIEMQGIQKEFEILNILEFNSSRKRMSCIVKIPGLNPGDEPRALLICKGADSIIYSRLSRQSGSNSEAILEKTALHLEQYATEGLRTLCIAQRELSWSEYEKWNEKYDIAAASLANREDELEVVADSIERELILLGGTAIEDRLQDGVPDCIELLAEAGIKLWVLTGDKVETAINIGFSCNLLNNEMELLVIKTTGDDVKEFGSEPSEIVDALLSKYLKEYFNLTGSEEEIFEAKKDHEFPKGNYAIVIDGDALKLALYGEDIRRKFLLLCKNCRAVLCCRVSPSQKAAVVKLVKDSLDVMTLAIGDGSNDVAMIQSADVGIGIAGEEGRQAVMCSDYAIGQFRYLARLVLVHGRWSYKRLAEMIPEFFYKNMIFALALFWYGIYNDFDGSYLYEYTYMMFYNLAFTSLPVIFLGILDQDVNDTISLVVPQLYRVGILRKEWNQRKFLWYMLDGLYQSIICFFFPYLVYHKNMIVTSNGLGLDHRYFVGVYVTTIAVISCNTYVLLHQYRWDWFSGLFIALSCLVVFAWTGIWSSAIASREFFKAAARIYGAPSFWAVFFVAVLFCLLPRFTYDSFQKFFYPTDVEIVREMWQHGHFDHYPPGYDPTDPNRPKVTKAGQHGEKIIEGIALSDNLGGSNYSRDSVVTEEIPMTFMHGEDGSPSGYQKQETWMTSPKETQDLLQSPQFQQAQTFGRGPSTNVRSSLDRTREQMIATNQLDNRYSVERARTSLDLPGVTNAASLIGTQQNN

SEQ ID NO: 33 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 34 - protein, 1173 aa, Saccharomyces cerevisiae
MSRQDENSALLANNENNKPSYTGNENGVYDNFKLSKSQLSDLHNPKSIRSFVRLFGYESNSLFKYLKTDKNAGISLPEISNYRKTNRYKNYGDNSLPERIPKSFLQLVWAAFNDKTMQLLTVAAVVSFVLGLYELWMQPPQYDPEGNKIKQVDWIEGVAIMIAVFVVVLVSAANDYQKELQFAKLNKKKENRKIIVIRNDQEILISIHHVLVGDVISLQTGDVVPADCVMISGKCEADESSITGESNTIQKFPVDNSLRDFKKFNSIDSHNHSKPLDIGDVNEDGNKIADCMLISGSRILSGLGRGVITSVGINSVYGQTMTSLNAEPESTPLQLHLSQLADNISVYGCVSAIILFLVLFTRYLFYIIPEDGRFHDLDPAQKGSKFMNIFITSITVIVVAVPEGLPLAVTLALAFATTRMTKDGNLVRVLRSCETMGSATAVCSDKTGTLTENVMTVVRGFPGNSKFDDSKSLPVSEQRKLNSKKVFEENCSSSLRNDLLANIVLNSTAFENRDYKKNDKNTNGSKNMSKNLSFLDKCKSRLSFFKKGNREDDEDQLFKNVNKGRQEPFIGSKTETALLSLARLSLGLQPGELQYLRDQPMEKFNIEKVVQTIPFESSRKWAGLVVKYKEGKNKKPFYRFFIKGAAEIVSKNCSYKRNSDDTLEEINEDNKKETDDEIKNLASDALRAISVAHKDFCECDSWPPEQLRDKDSPNIAALDLLFNSQKGLILDGLLGIQDPLRAGVRESVQQCQRAGVTVRMVTGDNILTAKAIARNCAILSTDISSEAYSAMEGTEFRKLTKNERIRILPNLRVLARSSPEDKRLLVETLKGMGDVVAVTGDGTNDAPALKLADVGFSMGISGTEVAREASDIILMTDDFSAIVNAIKWGRCVSVSIKKFIQFQLIVNITAVILTFVSSVASSDETSVLTAVQLLWINLIMDTLAALALATDKPDPNIMDRKPRGRSTSLISVSTWKMILSQATLQLIVTFILHFYGPELFFKKHEDEITSHQQQQLNAMTFNTFVWLQFFTMLVSRKLDEGDGISNWRGRISAANLNFFQDLGRNYYFLTIMAIIGSCQVLIMFFGGAPFSIARQTKSMWITAVLCGMLSLIMGVLVRICPDEVAVKVFPAAFVQRFKYVFGLEFLRKNHTGKHDDEEALLEESDSPESTAFY

SEQ ID NO: 35 - protein, 1068 aa, Saccharomyces cerevisiae
MRGLTPKNGVHIETGPDTESSADSSNFSTGFSGKIRKPRSKVSKACDNCRKRKIKCNGKFPCASCEIYSCECTFSTRQGGARIKNLHKTSLEGTTVQVKEETDSSSTSFSNPQRCTDGPCAVEQPTKFFENFKLGGRSSGDNSGSDGKNDDDVNRNGFYEDDSESQATLTSLQTTLKNLKEMAHLGTHVTSAIESIELQISDLLKRWEPKVRTKELATTKFYPNKSIETQLMKNKYCDVVHLTRYAAWSNNKKDQDTSSQPLIDEIFGLYSPFQFLSLQGIGKCFQNYRSKSKCEIFPRTAKETIYIMLRFFDVCFHHINQGCVSIANPLENYLQKMNLLPSTPSSISSAGSPNTAHTKSHVALVINHLPQPFVRNITGISNSELLSEMNNDISMFGILLKMLDMHKNSYQNFLMEITSNPSVAKNTQSIDVLQEFIHYCQAGEALIALCYSYYNSTLYNYVDFTCDITHLEQLLYFLDLLFWLSEIYGFEKVLNVAVHFVSRVGLSRWEFYVGLDENFAERRRNLWWKAFYFEKTLASKLGYPSNIDDSKINCLLPKNFRDVGFLDNRDFIENVHLVRRSEAFDNMCISDLKYYGELAVLQIVSHFSSSVLFNEKFTSIRNTSKPSVVREKLLFEVLEIFNETEMKYDAIKEQTGKLFDIAFSKDSTELKVSREDKIMASKFVLFYEHHFCRMVNESDNIVARLCVHRRPSILIENLKIYLHKIYKSWTDMNKILLDFDNDYSVYRSFAHYSISCIILVSQAFSVAEFIKVNDVVNMIRVFKRFLDIKIFSENETNEHVFNSQSFKDYTRAFSFLTIVTRIMLLAYGESSSTNLDVISKYIDENAPDLKGIIELVLDTNSCAYRFLLEPVQKSGFHLTVSQMLKNRKFQEPLMSNEDNKQMKHNSGKNLNPDLPSLKTGTSCLLNGIESPQLPFNGRSAPSPVRNNSLPEFAQLPSFRSLSVSDMINPDYAQPTNGQNNTQVQSNKPINAQQQIPTSVQVPFMNTNEINNNNNNNNNNKNNINNINNNNSNNFSATSFNLGTLDEFVNNGDLEDLYSILWSDVYPDS

SEQ ID NO: 36 - protein, 376 aa, Saccharomyces cerevisiae
MSNVTTPWWKQWDPSEVTLADKTPDDVWKTCVLQGVYFGGNEYNGNLGARISSVFVILFVSTFFTMFPLISTKVKRLRIPLYVYLFAKYFGSGVIVATAFIHLMDPAYGAIGGTTCVGQTGNWGLYSWCPAIMLTSLTFTFLTDLFSSVWVERKYGLSHDHTHDEIKDTVVRNTAAVSSENDNENGTANGSHDTKNGVEYYEDSDATSMDVVQSFQAQFYAFLILEFGVIFHSVMIGLNLGSVGDEFSSLYPVLVFHQSFEGLGIGARLSAIEFPRSKRWWPWALCVAYGLTTPICVAIGLGVRTRYVSGSYTALVISGVLDAISAGILLYTGLVELLARDFIFNPQRTKDLRELSFNVICTLFGAGIMALIGKWA

SEQ ID NO: 37 - protein, 1036 aa, Saccharomyces cerevisiae
MGRTIRRRRSNSSLSEAISVSLGINQDSSVNKMHRASVSAMSPPLCRSYMSGFFTGGNSPMINNLSDSKLPISNKQHPKVIHGSENLHRQTAQLSNEFCSSSVEENSPTIKDYMDIIGNGDRKDDQSMRTIEENIDEEYSDEYSRLLLSPASSNVDDDRNRGLQNSSLPELEDGYAGGYQSLRPSHNLRFRPRNLWHMCTSFPSKFAHYLPAAVLGLLLNILDALSYGMIIFPITEPVFSHLGPTGISMFYISTIISQAVYSGGWSSFPSGIGSEMIEITPFYHTMALAIKEALAGNDDEIITTTIFCYVISSMLTGVVFYALGKLRLGKIVGFFPRHILIGCIGGVGYFLIITGIEVTTRVAKFEYSWPFFSGLFTDYDTLAKWLLPVLLTVVLIGTQRYFKNSLVLPSFYILTLVLFHFIVAIIPTLSLDALRQAGWIFPIANSDSKWYDHYRLFNVHKVHWSLVLQQIPTMMALTFFGILHVPINVPALAMSLQMDKYDVDRELIAHGYSNFFSGLLGSVQNYLVYTNSVLFIRAGADSPFAGFLLIALTICIMIIGPVIISFIPICIVGSLIFLLGYELLVEALVDTWNKLNRFEYLTVVIIVFTMGIFDFVLGIIVGILIACFSFLVDSTKLQTINGEYNGNVARSTVYRDYVQTKFLDGIGEQIYVLKLQNLLFFGTIISIEEKIERLLQISNKDATKRRIKYLILDFKNINADNIDYSAAEGFNRIKRFTETKRIKLIISSIKERDRIYNAFNNVGLLNDVELFADLNSALEWCENEFLFQYKQLRKKAKERLEEGKQNNVVSAVIAATKNKKIDTIGNGLNRGSNGDTARNLMSLPTNTPRNYQILSVAQNVFVNDEQAVKNFKKEYKDDEPVLPILLFALKQYRPDIISEVQKVREKEIKFWAQLCPYFTRRRLASQSHLLHADNIFFLVETGMLKATYELPQGTLYEIFSNGTCFGKIIAPGNAMPREQKLTIETETDSVLWVIDSSSLNKLKEDNLALYVEVALMVMCIKDTRFKELLGYTLVSA

SEQ ID NO: 38 - protein, 105 aa, Saccharomyces cerevisiae
MGLSSIFGGGAPSQQKEAATTAKTTPNPIAKELKNQIAQELAVANATELVNKISENCFEKCLTSPYATRNDACIDQCLAKYMRSWNVISKAYISRIQNASASGEI

SEQ ID NO: 39 - protein, 2039 aa, Saccharomyces cerevisiae
MQGRKRTLTEPFEPNTNPFGDNAAVMTENVEDNSETDGNRLESKPQALVPPALNIVPPESSIHSTEEKKGDEYNGNDKDSSLISNIFRTRVGRSSHENLSRPKLSLKTASFGAAESSRRNVSPSTKSAKSSSQYIDLNDERLRRRSFSSYSRSSSRRVSNSPSSTDRPPRSAKVLSLIAADDMDDFEDLQKGFKSAIDEEGLTWLPQLKSEKSRPVSDVGEDRGEGEQESIPDVHTPNVGASATPGSIHLTPEPAQNGSVSEGLEGSINNSRKKPSPKFFHHLSPQKEDKDQTEVIEYAEDILDFETLQRKLESRPFVLYGHSLGVFSPTNPLRIKIARFLLHRRYSLLYNTLLTFYAILLAIRTYNPHNVVFLYRFSNWTDYFIFILSACFTGNDIAKIIAFGFWDDSEMFKAYGREYKSILQRSGIMKLYIYLREKYGRKLIDFIIPFRIISPGEETKYQRSSLSTSLTKPYGAKENQRPFGTPRAFARSSWNRIDLVSSVSFWLGMFLSIKSYDTKTGIRIFKPLAILRILRLVNVDTGMPSILRGLKYGIPQLVNVSSMLVYFWIFFGILGVQIFQGSFRRQCVWFNPEDPTDTYQYDMQFCGGYLDPVTKRKQNYIYEDGSEGSVSKGFLCPQYSKCVSNANPYNGRISFDNIVNSMELVFVIMSANTFTDLMYYTMDSDEMAACLFFIVCIFVLTIWLLNLLIAVLVSSFEIANEEYKKKKFIYGSRKTGYVARIVTGYWKYFKLKANQTKFPNWSQKGLAIYSHVEFIFVILIICDIGMRASVKVSTSANCNNILLKTDRGISIVLFIESLARLVLYLPNMWKFLTKPSYVYDFIISIITLVISCLAVEGVLGHMYAWLSIFHISRFYRVIISFNLTKKLWKQILSNGVMIWNLSSFYFFFTFLVAIIMAVYFEGVIPPEEMADQPFGMYSLPNSFLSLFIIGSTENWTDILYALQKHSPNISSTFFCSVFFIIWFLLSNSVILNIFIALISESMEVKEEEKRPQQIKHYLKFVYPQKIQEYTHASLVARIRKKFFGGHRNEDTRDFKQFLMRGTAIMNIAQNMGELADEFKEPPSENLFKKGLSKLTIGVPSLKRLRMFANNPFYKNSDVVFTETNDINGRTYILELNEYEDEKLDYLKKYPLFNYSYYFFSPQHRFRRFCQRLVPPSTGKRTDGSRFFEDSTDLYNKRSYFHHIERDVFVFIFALATILLIVCSCYVTPLYRMHHKMGTWNWSSALDCAFIGAFSIEFIVKTVADGFIYSPNAYLRNPWNFIDFCVLISMWINLIAYLKNNGNLSRIFKGLTALRALRCLTISNTARQTFNLVMFDGLNKIFEAGLISLSLLFPFTVWGLSIFKGRLGTCNDGSLGRADCYNEYSNSVFQWDIMSPRVYQQPYLHLDSFASAFSSLYQIISLEGWVDLLENMMNSSGIGTPATVMGSAGNALFLVLFNFLSMVFILNLFVSFIVNNQARTTGSAYFTIEEKAWLESQKLLSQAKPKAIPNLIELSRVRQFFYQLAVEKKNFYYASFLQVVLYLHIIMLLSRSYNPGNLIGYQGVYFMFSTSVFLIQEALHMCGEGPRLYFRQKWNSIRLSIIIIAFIMNAVAFHVPASHYWFHNIKGFFLLVIFLFIIPQNDTLTELLETAMASLPPILSLTYTWGVLFLVYAIALNQIFGLTRLGSNTTDNINFRTVIKSMIVLFRCSFGEGWNYIMADLTVSEPYCSSDDNSTYTDCGSETYAYLLLMSWNIISMYIFVNMFVSLIIGNFSYVYRSGGSRSGINRSEIKKYIEAWSKFDTDGTGELELSYLPRIMHSFDGPLSFKIWEGRLTIKSLVENYMEVNPDDPYDVKIDLIGLNKELNTIDKAKIIQRKLQYRRFVQSIHYTNAYNGCIRFSDLLLQIPLYTAYSARECLGIDQYVHHLYILGKVDKYLENQRNFDVLEMVVTRWKFHCRMKRTIEPEWDVKDPTVSSHISNINVNLEPAPGILEREPIATPRMDYGVNNFMWSPRMNQDSTMEPPEEPIDNNDDSANDLIDR

SEQ ID NO: 40 - protein, 613 aa, Saccharomyces cerevisiae
MKGEPKTYSMSDLSYYGEKAQQQNEKQQKQYVVRRNSTQSTSKQNVSVVLEDNASESNELPKGFILYASLIALALSLFLAALDIMIVSTIIEEVAKQFGSYSEIGWLFTGYSLPNALLALIWGRIATPIGFKETMLFAIVIFEIGSLISALANSMSMLIGGRVIAGVGGCGIQSLSFVIGSTLVEESQRGILIAVLSCSFAIASVVGPFLGGVFTSSVTWRWCFYVNLPIGGLAFFLFLFFYNPGLSTFQETMDNIRKFPSQFIEIVRNVAYHLLKIKGFSKLNGWRKPFMELIFMYDIIEFVFCSAGFTCILLAFTFGGNRYAWNSASIIILFIIGIVLVVLAGIYDFLVFPKFNIVKATPHYQPLMSWTNIKKPGIFTVNIALFLTCAGYISQFTYIVQYFQLIYNDSAWRAAVHLVACIISTVVTAILCGAITDKTRQIKPIIVISSIFGVVGAGILTLLNNNANNSAHIGLLILPGVAFGGLAQSSMLASQIQLDKKSPTFRSDFVSITTFNTFCKNLGQALGGVISNTVFSAAAIKKLTKANIQLPDGTTVDNLVIYRQTNFDGSHSKLGNIISESLTDVFYMALGFYALSLIFAVFASNKKVTASLR

SEQ ID NO: 41 - protein, 1477 aa, Saccharomyces cerevisiae
MTITVGDAVSETELENKSQNVVLSPKASASSDISTDVDKDTSSSWDDKSLLPTGEYIVDRNKPQTYLNSDDIEKVTESDIFPQKRLFSFLHSKKIPEVPQTDDERKIYPLFHTNIISNMFFWWVLPILRVGYKRTIQPNDLFKMDPRMSIETLYDDFEKNMIYYFEKTRKKYRKRHPEATEEEVMENAKLPKHTVLRALLFTFKKQYFMSIVFAILANCTSGFNPMITKRLIEFVEEKAIFHSMHVNKGIGYAIGACLMMFVNGLTFNHFFHTSQLTGVQAKSILTKAAMKKMFNASNYARHCFPNGKVTSFVTTDLARIEFALSFQPFLAGFPAILAICIVLLIVNLGPIALVGIGIFFGGFFISLFAFKLILGFRIAANIFTDARVTMMREVLNNIKMIKYYTWEDAYEKNIQDIRTKEISKVRKMQLSRNFLIAMAMSLPSIASLVTFLAMYKVNKGGRQPGNIFASLSLFQVLSLQMFFLPIAIGTGIDMIIGLGRLQSLLEAPEDDPNQMIEMKPSPGFDPKLALKMTHCSFEWEDYELNDAIEEAKGEAKDEGKKNKKKRKDTWGKPSASTNKAKRLDNMLKDRDGPEDLEKTSFRGFKDLNFDIKKGEFIMITGPIGTGKSSLLNAMAGSMRKTDGKVEVNGDLLMCGYPWIQNASVRDNIIFGSPFNKEKYDEVVRVCSLKADLDILPAGDMTEIGERGITLSGGQKARINLARSVYKKKDIYLFDDVLSAVDSRVGKHIMDECLTGMLANKTRILATHQLSLIERASRVIVLGTDGQVDIGTVDELKARNQTLINLLQFSSQNSEKEDEEQEAVVAGELGQLKYESEVKELTELKKKATEMSQTANSGKIVADGHTSSKEERAVNSISLKIYREYIKAAVGKWGFIALPLYAILVVGTTFCSLFSSVWLSYWTENKFKNRPPSFYMGLYSFFVFAAFIFMNGQFTILCAMGIMASKWLNLRAVKRILHTPMSYIDTTPLGRILNRFTKDTDSLDNELTESLRLMTSQFANIVGVCVMCIVYLPWFAIAIPFLLVIFVLIADHYQSSGREIKRLEAVQRSFVYNNLNEVLGGMDTIKAYRSQERFLAKSDFLINKMNEAGYLVVVLQRWVGIFLDMVAIAFALIITLLCVTRAFPISAASVGVLLTYVLQLPGLLNTILRAMTQTENDMNSAERLVTYATELPLEASYRKPEMTPPESWPSMGEIIFENVDFAYRPGLPIVLKNLNLNIKSGEKIGICGRTGAGKSTIMSALYRLNELTAGKILIDNVDISQLGLFDLRRKLAIIPQDPVLFRGTIRKNLDPFNERTDDELWDALVRGGAIAKDDLPEVKLQKPDENGTHGKMHKFHLDQAVEEEGSNFSLGERQLLALTRALVRQSKILILDEATSSVDYETDGKIQTRIVEEFGDCTILCIAHRLKTIVNYDRILVLEKGEVAEFDTPWTLFSQEDSIFRSMCSRSGIVENDFENRS

SEQ ID NO: 42 - protein, 735 aa, Saccharomyces cerevisiae
MGEFKPPLPQGAGYAIVLGLGAVFAGMMVLTTYLLKRYQKEIITAEEFTTAGRSVKTGLVAAAVVSSWIWCSTLLTSSTKEYADGIFGGYAYAAGACFQIIAFAILAIKTKQMAPNAHTYLELVRTRYGKIGHGCYLFYAIATNILVTSMLLTSGSAVFSDLTGMNTIASCFLLPVGVVVYTLFGGIKATFLTDYMHTCVIIIIVLVFAFKVYATSDVLGSPGKVYDLVREAAKRHPVDGNYQGEYMTMTSKSAGILLIINLIGNFGTVFLDNGYWNKAISASPAASLKAYAIGGLAWFAVPSLISLTMGLACLAVETSPNFPTYPDPLTSFQANSGLVLPAAAIAIMGKGGAVASLLMIFMAVTSAMSAELIAVSSVFTYDIYREYIDPRASGKKLIYTSHVACIFFGLAMSGFSVGLYYGGISMGYIYEMMGIIISSAVLPVVLTLCSKDMNLVAAVVSPILGTGLAIMSWLVCTKSLYKELTVDTTFMDYPMLTGNLVALLSPAIFIPILTYVFKPQNFDWEKMKDITRVDETAELVQADPDIQLYDAEANDKEQEEETNSLVSDSEKNDVRVNNEKLIEPNLGVVISNAIFQEDDTQLQNELDEEQRELARGLKIAYFLCVFFALAFLVVWPMPMYGSKYIFSKKFFTGWVVVMIIWLFFSAFAVCIYPLWEGRHGIYTTLRGLYWDLSGQTYKLREWQNSNPQDLHVVTSQISARAHRQSSHFGQVDEII

SEQ ID NO: 43 - protein, 490 aa, Saccharomyces cerevisiae
MEATSSALSSTANLVKTIVGAGTLAIPYSFKSDGVLVGVILTLLAAVTSGLGLFVLSKCSKTLINPRNSSFFTLCMLTYPTLAPIFDLAMIVQCFGVGLSYLVLIGDLFPGLFGGERNYWIIASAVIIIPLCLVKKLDQLKYSSILGLFALAYISILVFSHFVFELGKGELTNILRNDICWWKIHDFKGLLSTFSIIIFAFTGSMNLFPMINELKDNSMENITFVINNSISLSTALFLIVGLSGYLTFGNETLGNLMLNYDPNSIWIVIGKFCLGSMLILSFPLLFHPLRIAVNNVIIWIEITYGGANPEEDPQVSEYTRASNLRPISMTVEDPAQPSDALDATSYNEQECLLPNGNFDNGSIESQENNNDERGTMAVAGDNEHHAPFVKSRFYWITALLLISMYTLALSVQSFALVLSFVGATGSTSISFTLPGLLGYKLIGLDSLAIGKMIPPKDRFYKRCSLLLVFYGLSVMFLSLYVTVFNRSDEA

SEQ ID NO: 44 - protein, 691 aa, Saccharomyces cerevisiae
MTRFMNSFAKQTLGYGNMATVEQESSAQAVDSHSNNTPKQAKGVLAEELKDALRFRDERVSIINAEPSSTLFVFWFVVSCYFPVITACLGPVANTISIACVVEKWRSLKNNSVVTNPRSNDTDVLMNQVKTVFDPPGIFAVNIISLVLGFTSNIILMLHFSKKLTYLKSQLINITGWTIAGGMLLVDVIVCSLNDMPSIYSKTIGFWFACISSGLYLVCTIILTIHFIGYKLGKYPPTFNLLPNERSIMAYTVLLSLWLIWGAGMFSGLLHITYGNALYFCTVSLLTVGLGDILPKSVGAKIMVLIFSLSGVVLMGLIVFMTRSIIQKSSGPIFFFHRVEKGRSKSWKHYMDSSKNLSEREAFDLMKCIRQTASRKQHWFSLSVTIAIFMAFWLLGALVFKFAENWSYFNCIYFCFLCLLTIGYGDYAPRTGAGRAFFVIWALGAVPLMGAILSTVGDLLFDISTSLDIKIGESFNNKVKSIVFNGRQRALSFMVNTGEIFEESDTADGDLEENTTSSQSSQISEFNDNNSEENDSGVTSPPASLQESFSSLSKASSPEGILPLEYVSSAEYALQDSGTCNLRNLQELLKAVKKLHRICLADKDYTLSFSDWSYIHKLHLRNITDIEEYTRGPEFWISPDTPLKFPLNEPHFAFMMLFKNIEELVGNLVEDEELYKVISKRKFLGEHRKTL

SEQ ID NO: 45 - protein, 873 aa, Saccharomyces cerevisiae
MANTVGGILSGVNPFHYNSSSPLTLFLFQACLILLVCNLIHIPFSMMRQPKVISEVISGVILGPTIFGQIPNYTNTIFPTSSIPGLNLVANLGIILFMFFLGLEVDIAFIKKHLKKALVIGIVTLAVPFGFGCLLAIPLFHTYANKTEGERHIKFSVFMVFIAVSISVTAFPVLCRILNELRLIKDRAGIVVLAAGIINDIMGWILLALSIILSSAEGSPVNTVYILLITFAWFLIYFFPLKYLLRWVLIRTHELDRSKPSPLATMCILFIMFISAYFTDIIGVHPIFGAFIAGLVVPRDDHYVVKLTERMEDIPNIVFIPIYFAVAGLNVDLTLLNEGRDWGYVFATIGIAIFTKIISGTLTAKLTGLFWREATAAGVLMSCKGIVEIVVLTVGLNAGIISRKIFGMFVLMALVSTFVTTPLTQLVYPDSYRDGVRKSLSTPAEDDGAADGLDSEGVDKTEINTQLNSLADVSKYRIGELTTVINTTEAISPSLKLLNYLSLGVSPKPKNNKHKNETSLSRMTTATDSTLKSNTFKIKKMVHIWSKSVDDVDTNLSVIDEKLTPFEGVGALRAIHLRLLTERTTDLLQSSSLYNDDPHFTANTDSLLQIFDIFSNLSKIPFSSEVIFSTMREKAANIATMKMDSTDLILLPLKGASYEYRGSPVFIDEKYANFDHIYSHLLGLNELSSTFFKSIFQSLKANFAVQISNTYGRLNADRFKRKRFNLLLPKPYLTQSDYLGLYLLLLICYRDGYNNDNASCSIFINSKNIDFAKDLSTAFAEHDWLNESTIKIVDIPFETKVPEEAIEKPSFIETVLDVGLSDTALADIEETTFIIGEDLPDESEPFSEEVRTVIFEGSNRRFDTLIVHHFSSE

SEQ ID NO: 46 - protein, 383 aa, Saccharomyces cerevisiae
MIVSFGDATTRTSEVQLVRCTQGLNLWKLHQVHAVYKRVVHDTLGADEGNALLDQILADTNLYPPWMCVLLYAFCSAMVTPYAFGGDWVNLAISFFMGLCVGSLQFILSQKSYMYSNVFEISASIVVSFCGRAFGSIPRSHICFGAVTQGSLALILPGYIILCGALELQSRSLVAGAVRMFYAIIYSLFLGFGITLGSALFGWMYHNATNEISCPQLISPWFRFLFVPAFTISISLLNQAHISQLPVMVFISCTGYVVTYWAGKHFANSTEFTAALAAFVIGVLGNLYSRIWKGLAVSAMLPAIFVQVPSGIASQNSLLSGLQSANTIVNANETITTSTSDPSSSMSFGMTMIQVCVGISVGLFASSLFVYPFGKKKTGLFSL

SEQ ID NO: 47 - protein, 799 aa, Saccharomyces cerevisiae
MSTIYRESDSLESEPSPTPTTIPIQINMEEEKKDAFVKNIDEDVNNLTATTDEEDRDPESQKFDRHSIQEEGLVWKGDPTYLPNSPYPEVRSAVSIEDDPTIRLNHWRTWFLTTVFVVVFAGVNQFFSLRYPSLEINFLVAQVVCYPIGRILALLPDWKCSKVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRKVEKTVANGWTMPRYRFFLIVLIGSFIWYWVPGFLFTGLSYFNVILWGSKTRHNFIANTIFGTQSGLGALPITFDYTQVSQAMSGSVFATPFYVSANTYASVLIFFVIVLPCLYFTNTWYAKYMPVISGSTYDNTQNKYNVTKILNEDYSINLEKYKEYSPVFVPFSYLLSYALNFAAVIAVFVHCILYHGKDIVAKFKDRKNGGTDIHMRIYSKNYKDCPDWWYLLLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAVQIYATIISGMVNVGVQEWMMHNIDGLCTTDQPNGFTCANGRTVFNASIIWSLPKYLFSSGRIYNPLMWFFLIGLLFPLAVYAVQWKFPKFKFAKHIHTPVFFTGPGNIPPSTPYNYSLFFAMSFCLNLIRKRWRAWFNKYNFVMGAGVEAGVAISVVIIFLCVQYPGGKLSWWGNNVWKRTYDNDYKKFYTLKKGETFGYDKWW

SEQ ID NO: 48 - protein, 725 aa, Saccharomyces cerevisiae
MDWAINVAHPRLLYKDPKLSVTFIVPSLFHIIIAFVLLGICASDFLCPNVAHISDPNSLRSNGSLVSKTASHASHTGALMAVLLSWCNSSPDLFSNLMSWATSTRETRSTSVSLSIGEVLGACGIILCIVEGSIFIIMSRTHIEISQIQKLSIMRDLLFSLAAMCVMSYVSLMNQVTVLNCLLMAFLYAFYLVVKLTFKLNHSAETPDETAADTSLRENSVSPFLDDSLMASGLLPPIQPGFDISNSITHGIKPSLLSAMDFNSFLSMLENSSLEEDDSRNEMAELNTLRSMTPGQHWSASATVAGEATSAGRPFSEPTNAFTEYRDSERAINSSPAVFAPYRDNPDDEESQEQVLLETTTHGHFGAQEMRRFSKRSLGWIIKIFIPHLSNFSQKSISDAIFSIITVPFFIIFKLSCPQPPSDILSYDPTLNRYSLTTLPIILLFIQSITAPFLLCSILSVLLTYHLGYLVYLFPLILAMALILLLTAFITKVNLHNKFTLSLDSSNILQEKLQKRKLLERLNTSIQIIFLAIGIINIIIWISLLANSLIEMMEIYQKILGLSKAILGLTIFAWGNSVGDLISNISMCRLYKTQTHYQDRVRLATKFFMISCASCLGGVMLNSMGGIGFSGLVSMLFIGAFNDNEWWFLRKVKLQETSQLDNTLNYKFIVSCVFIILQIILLLLFFGGPNNIKRRLTKEMKLVGISMCGLWALATLINILLELFS

SEQ ID NO: 49 - protein, 602 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPPKDVSHNDPKGDIEASIAEE

SEQ ID NO: 50 - protein, 969 aa, Saccharomyces cerevisiae
MSTDNSQKDEGVPLLSPYSSSPQLRKKKRNQKRRKDKFVGHLKSDSRRPTQLLHDNLQHNHGQITDFDQIDSWGMLHESDSTSNDIIKSEDPSLKGAFIDHRPSMSQPREGPQSVSSTVQPQPIMKFSTPSYKKPAGLRPSDQNRSLVSDLSPSELESWLKRRKSVHKSFVDENSPTDRRQSNANNDVVIDVDALMNHVNNNASTGVNDNSKRRKKKRGSDDSSNKNSKSTSSDSNDEEDEYNSRPSSSLSSNNSSLDDVCLVLDDEGSEVPKAWPDCTVLEEFSKEETERLRSQAIQDAEAFHFQYDEDEEDGTSNEDGILFSKPIVTNIDVPELGNRRVNETENLKNGRLRPKRIAPWHLIQRPMVLGSNSTKDSKSRIQSGLQDNLLVGRNIQYPPHIISNNPEHFRFTYFRVDLDSTVHSPTISGLLQPGQKFQDLFVASIYSQDNSAGHIKTHPNSPTPGIKAETVSQLQGLTAKNPSTLSSMSVANIEDVPPFWLDVSNPTEEEMKILSKAFGIHPLTTEDIFLGEVREKVELFRDYYLICFRSFDIVAEKHVRRRRKEKQESATLDHESISRRKSQAYGATMSNESNANNNNSTSNASRSKWLPSILRARRRSSANRTTNTSSSSYKRRVKSEKKKMEENEKFKRKSGDRHKPREGELEPLNVYIIVFRTGVLTFHFAPTPHPINVRRRARLLKDYLNVTSDWIAYALIDDITDAFAPMIELIEDEVYEIEDAILKMHQSDDSSDSDSSDSDSDSGASDEDAFPFDVYSKKTSYSSAKSSVSSRSMSTSEASFNANLIGWKRKGDMLRRIGECRKRVMSILRLLGSKADVIKGFAKRYNEQWEASPQSEIAMYLGDIQDHIVTMVSSLNHYEKLLSRSHSNYLAQINIDMTKVNNDMNDVLGKITILGTIVLPMNVITGLWGMNVIVPGQYRDSLTWFIGIVLFMCMLACSAYMYTKRRFGF

SEQ ID NO: 51 - protein, 889 aa, Saccharomyces cerevisiae
MPTAKRTSSRASLALPFQLRLVHKKSWGHRLRDFISGFLKSCRPIAKYVFPNFIVVHYIYLITLSIIGSILLYPCKNTAFIDVLFLAAGASTQGGLATKSTNDFNLYQQIVVYVITLLSTPILIHGFLAFVRLYWFERYFDNIRDISKQNFKLRRTMTLQQRELSGSSGNAARSRSFKDNLFRGKFVSREDPRQSASDVPMDSPDTSALSSISPLNVSSSKEESSDTQSSPPNFSSKRQPSDVDPRDIYKSIMMLQKQQEKSNANSTDSFSSETNGPAFIVQERHERRAPHCSLKRHSVLPSSQELNKLAQTKSFQKLLGLRRDEGDHDYFDGAPHKYMVTKKKKISRTQSCNIPTYTASPSPKTSGQVVENHRNLAKSAPSSFVDEEMSFSPQESLNLQFQAHPPKPKRREGDIGHPFTRTMSTNYLSWQPTFGRNSVFIGLTKQQKEELGGVEYRALRLLCCILMVYYIGFNILAFVTIVPWACTRHHYSEIIRRNGVSPTWWGFFTAMSAFSNLGLSLTADSMVSFDTAPYPLIFMMFFIIIGNTGFPIMLRFIIWIMFKTSRDLSQFKESLGFLLDHPRRCFTLLFPSGPTWWLFTTLVVLNATDWILFIILDFNSAVVRQVAKGYRALMGLFQSVCTRTAGFNVVDLSKLHPSIQVSYMLMMYVSVLPLAISIRRTNVYEEQSLGLYDSGQDDENITHEDDIKETDHDGESEERDTVSTKSKPKKQSPKSFVGAHLRRQLSFDLWYLFLGLFIICICEGRKIEDVNKPDFNVFAILFEVVSAYGTVGLSLGYPNTNTSLSAQFTVLSKLVIIAMLIRGRNRGLPYTLDRAIMLPSDKLEQIDRLQDMKAKGKLLAKVGEDPMTTYVKKRSHKLKKIATKFWGKH

SEQ ID NO: 52 - protein, 582 aa, Saccharomyces cerevisiae
MEETKYSSQQEIEGACGSDASLNARGSNDSPMGLSLYLCLASLTLVLFITALDILIVGTIIDVVAEQFGNYSKTGWLVTGYSLPNAILSLIWGRFASIIGFQHSLILAILIFEAGSLIAALASSMNMLIFGRVVAGVGGSGLQTLCFVIGCTMVGERSRPLVISILSCAFAVAAIVGPIIGGAFTTHVTWRWCFYINLPIGGLAIIMFLLTYKAENKGILQQIKDAIGTISSFTFSKFRHQVNFKRLMNGIIFKFDFFGFALCSAGLVLFLLGLTFGGNKYSWNSGQVITYLVLGVLLFIFSLVYDFFLFDKFNPEPDNISYRPLLLRRLVAKPAIIIVNMVTFLLCTGYNGQMIYSVQFFQLIFASSAWKAGLHLIPIVITNVIAAIASGVITKKLGLVKPLLIFGGVLGVIGAGLMTLMTNTSTKSTQIGVLLLPGFSLGFALQASLMSAQLQITKDRPEAAMDFIEVTAFNTFMKSLGTTLGGVLSTTVFSASFHNKVSRAHLEPYEGKTVDDMILYRLQNYDGSHSTIGNILSDSIKNVFWMDLGFYALGFLFCSFSSNKKLIIPKKDDTPEDNLEDK

SEQ ID NO: 53 - protein, 615 aa, Saccharomyces cerevisiae
MSSSVVGASSNKKSGIRQSCEIIERERHSNDDTYSMTSTFFKLKENEIMSAQFDSLKYKILLISTAFVCGFGISLDYTLRSTYTGYATNSYSEHSLLSTVQVINAVVSVGSQVVYSRLSDHFGRLRLFLVATIFYIMGTIIQSQATRLTMYAAGSVFYNCGYVGTNLLLTLILSDFSSLKWRMFYQYASYWPYIIIPWISGNIITAANPQKNWSWNIAMWAFIYPLSTLPIIFLILYMKYKSSKTAEWRSLKEQARKERTGGLFENLVFLFWKLDIVGILLITVSLGCILVPLTLANETSQKWHNSKIIATLVSGGCLFFIFLYWEAKFAKSPLLPFKLLSDRGIWAPLGVTFFNFFTFFISCDYLYPVLLVSMKESSTSAARIVNLPDFVAATASPFYSLLVAKTRKLKLSVIGGCAAWMVCMGLFYKYRGGSGSHEGVIAASVIMGLSGLLCSNSVIVILQAMTTHSRMAVITGIQYTFSKLGAAIGASVSGAIWTQTMPNQLYKNLGNDTLAEIAYASPYTFISDYPWGSPERDAVVESYRYVQRIIMTVGLACTVPFFTFTMFMRNPELIDKATHEEFTEDGLVVLPDEENIFSQIKALFRHNRSNKKSGC

SEQ ID NO: 54 - protein, 345 aa, Saccharomyces cerevisiae
MEGVYFNIDNGFIEGVVRGYRNGLLSNNQYINLTQCDTLEDLKLQLSSTDYGNFLSSVSSESLTTSLIQEYASSKLYHEFNYIRDQSSGSTRKFMDYITYGYMIDNVALMITGTIHDRDKGEILQRCHPLGWFDTLPTLSVATDLESLYETVLVDTPLAPYFKNCFDTAEELDDMNIEIIRNKLYKAYLEDFYNFVTEEIPEPAKECMQTLLGFEADRRSINIALNSLQSSDIDPDLKSDLLPNIGKLYPLATFHLAQAQDFEGVRAALANVYEYRGFLETGNLEDHFYQLEMELCRDAFTQQFAISTVWAWMKSKEQEVRNITWIAECIAQNQRERINNYISVY

SEQ ID NO: 55 - protein, 542 aa, Saccharomyces cerevisiae
MGNQSLVVLTESKGEYENETELPVKKSSRDNNIGESLTATAFTQSEDEMVDSNQKWQNPNYFKYAWQEYLFIFTCMISQLLNQAGTTQTLSIMNILSDSFGSEGNSKSWLMASFPLVSGSFILISGRLGDIYGLKKMLLVGYVLVIIWSLICGITKYSGSDTFFIISRAFQGLGIAFVLPNVLGIIGNIYVGGTFRKNIVISFVGAMAPIGATLGCLFAGLIGTEDPKQWPWAFYAYSIAAFINFVLSIYAIPSTIPTNIHHFSMDWIGSVLGVIGLILLNFVWNQAPISGWNQAYIIVILIISVIFLVVFIIYEIRFAKTPLLPRAVIKDRHMIQIMLALFFGWGSFGIFTFYYFQFQLNIRQYTALWAGGTYFMFLIWGIIAALLVGFTIKNVSPSVFLFFSMVAFNVGSIMASVTPVHETYFRTQLGTMIILSFGMDLSFPASSIIFSDNLPMEYQGMAGSLVNTVVNYSMSLCLGMGATVETQVNSDGKHLLKGYRGAQYLGIGLASLACMISGLYMVESFIKGRRARAAAEYDCTVA

SEQ ID NO: 56 - protein, 434 aa, Saccharomyces cerevisiae
MKTQYSLIRKIWAHSVTEFLKSQWFFICLAILIVIARFAPNFARDGGLIKGQYSIGYGCVAWIFLQSGLGMKSRSLMANMLNWRAHATILVLSFLITSSIVYGFCCAVKAANDPKIDDWVLIGLILTATCPTTVASNVIMTTNAGGNSLLCVCEVFIGNLLGAFITPALVQMFTNRAPFAYGNPATGNGIGALYGRVMKQVGLSVFVPLFVGQVIQNCFPKGTAYYLGFLKKYHIKIGSYMLLLIMFSSFSTAFYQDAFTSVSHVCIIFLCFFNLGIYIFFTGLSYLCARPWFILKLFPHEPIEGKSTRLYRYSYNIFRPFYYSKEDAICIMFCGPAKTAALGVSLITSQYGDKKEHLGKLLVPLVLYQVEQVMTANFFVSLFKRWIQKDAQADGSESSCANENEEVDLEKIISIGTGENQSVLSNNVPYTQPR

SEQ ID NO: 57 - protein, 309 aa, Saccharomyces cerevisiae
MSHTETQTQQSHFGVDFLMGGVSAAIAKTGAAPIERVKLLMQNQEEMLKQGSLDTRYKGILDCFKRTATHEGIVSFWRGNTANVLRYFPTQALNFAFKDKIKSLLSYDRERDGYAKWFAGNLFSGGAAGGLSLLFVYSLDYARTRLAADARGSKSTSQRQFNGLLDVYKKTLKTDGLLGLYRGFVPSVLGIIVYRGLYFGLYDSFKPVLLTGALEGSFVASFLLGWVITMGASTASYPLDTVRRRMMMTSGQTIKYDGALDCLRKIVQKEGAYSLFKGCGANIFRGVAAAGVISLYDQLQLIMFGKKFK

SEQ ID NO: 58 - protein, 414 aa, Saccharomyces cerevisiae
MNPSVPKVMKRENNTHLLVSKEMNDTSLQLPSTTRSLSPKESNSNEDFNVDGNETTLQRISKDYLKPNIGLVLLTVSYFFNSAMVVSTKVLENDPDDIANDRQIKPLQILLVRMVITYIGTLIYMYINKSTISDVPFGKPEVRKWLVLRGCTGFFGVFGMYYSLMYLTISDAVLITFLAPSLTIFLSWVILRERFTKVEALGSLISLLGVVLIVRPSFLFGTPELTDSSSQIVESSDPKSRLIATLVGLWGVLGMSCVYIIIRYIGKRAHAIMSVSYFSLITAIVSFIGINTIPSMKFQIPHSKKQWILFGNLGVSGFIFQLLLTMGIQRERAGRGSLMTYTQLLYAVFWDVALYKHWPNIWSWIGMIIIISATLWVIRIRAANNETTAKDLTPIIDDEENSIPLTEFDLSDSK

SEQ ID NO: 59 - protein, 586 aa, Saccharomyces cerevisiae
MSRSNSIYTEDIEMYPTHNEQHLTREYTKPDGQTKSEKLNFEGAYINSHGTLSKTTTREIEGDLDSETSSHSSDDKVDPTQQITAETKAPYTLLSYGQKWGMVAILTMCGFWSSLGSPIYYPALRQLEKQFNVDENMVNVTVVVYLLFQGISPTVSGGLADCFGRRPIILAGMLIYVIASIGLACAPSYGVIIFLRCIQSIGISPTIAISSGVVGDFTLKHERGTFVGATSGFVLLGQCFGSLIGAVLTARWDWRAIFWFLTIGCGSCFLIAFLILPETKRTIAGNLSIKPKRFINRAPIFLLGPVRRRFKYDNPDYETLDPTIPKLDLSSAGKILVLPEIILSLFPSGLLFAMWTLMLSSISSGLSVAPYNYHLVIIGVCYLPGGIGGLMGSFFTGRIIDMYFKRKIKKFEQDKANGLIPQDAEINMFKVRLVCLLPQNFLAVVAYLLFGWSIDKGWRIESILITSFVCSYCAMSTLSTSTTLLVDLYPTKSSTASSCFNFVRCSLSTIFMGCFAKMKAAMTVGGTFTFLCALVFFFNFLMFIPMKYGMKWREDRLLKQQRQSWLNTLAVKAKKGTKRDQNDNHN

SEQ ID NO: 60 - protein, 60 aa, Saccharomyces cerevisiae
MSFLPSFILSDESKERISKILTLTHNVAHYGWIPFVLYLGWAHTSNRPNFLNLLSPLPSV

SEQ ID NO: 61 - protein, 494 aa, Saccharomyces cerevisiae
MLLKNCETDKQRDIRYACLFKELDVKGNGQVTLDNLISAFEKNDHPLKGNDEAIKMLFTAMDVNKDSVVDLSDFKKYASNAESQIWNGFQRIDLDHDGKIGINEINRYLSDLDNQSICNNELNHELSNEKVNKFSRFFEWAFPKRKANIALRGQASHKKNTDNDRSKKTTDSDLYVTYDQWRDFLLLVPRKQGSRLHTAYSYFYLFNEDVDLSSEGDVTLINDFIRGFGFFIAGGISGVISRTCTAPFDRLKVFLIARTDLSSILLNSKTDLLAKNPNADINKISSPLAKAVKSLYRQGGIKAFYVGNGLNVIKVFPESSIKFGSFEVTKKIMTKLEGCRDTKDLSKFSTYIAGGLAGMAAQFSVYPIDTLKFRVQCAPLDTKLKGNNLLFQTAKDMFREGGGQIILQRCHSRYSGHISLCCIRFGDFFCLKKMVYCQTGKDPEPTTRSGHSKQPGCTSNGCIQWNCRSFCCLSNQSFKNKTTSPRNICTSLCV

SEQ ID NO: 62 - protein, 642 aa, Saccharomyces cerevisiae
MVHITLGQAIWVSVKPIIKIYLIIGVGFLMAKMGILTVEATRIISDIVLTVLLPSLSFNKIVANIEDKDIKSVGIICLSALLIFGSGFFFAYVVRLFLPVPKQWYGGILAGGMFPNISDLPIAYLQSMDQGLVFSEEEGNKGVANVIIFLTMFLICIFNLGGFRLIESDFEYNDDESAVRVSETTKTQPAVSANTTNTDTSERFFSNEQQLFNNKYTARDSLTEAIGTKGENADVPPISRRSTNSIAPLSLPDTSSNSKITKPVQVKARNTIACTQSEESQATRGSNPLDSQSSASTIHSYNTSESYESSIDTMRARRTASQPRAYNTTTLLEENCLDEKCPKNMSMAALEPIRSIDMRALPSQNIHHLIREYSNVDQYGHQRRNSSLRGADMNDVHSISSNSTLQTIKTANLTRILTSDATVSKKDIETSGESLPQWMRKFSLTPLLVFFLKNCLRPCSMAVIIALTVAFIPWVKALFVTTANTPHISQAPDNAPPLSFFMDFTGYVGAACVPFGLILLGATLGRLKIGNLYPGFWKAAVTLVILRQCVMPIFGVLWCDRLVKAGWVNWQDDRMLLFVIAISWNLPTMTTLIYFTASFTPPETTAPIQMECVSFFLMLQYPLMVVSLPFLVSYFLKVQMNL

SEQ ID NO: 63 - protein, 617 aa, Saccharomyces cerevisiae
MKSFITRNKTAILATVAATGTAIGAYYYYNQLQQQQQRGKKNTINKDEKKDTKDSQKETEGAKKSTAPSNPPIYPVSSNGEPDFSNKANFTAEEKDKYALALKDKGNQFFRNKKYDDAIKYYNWALELKEDPVFYSNLSACYVSVGDLKKVVEMSTKALELKPDYSKVLLRRASANEGLGKFADAMFDLSVLSLNGDFNDASIEPMLERNLNKQAMSKLKEKFGDIDTATATPTELSTQPAKERKDKQENLPSVTSMASFFGIFKPELTFANYDESNEADKELMNGLSNLYKRSPESYDKADESFTKAARLFEEQLDKNNEDEKLKEKLAISLEHTGIFKFLKNDPLGAHEDIKKAIELFPRVNSYIYMALIMADRNDSTEYYNYFDKALKLDSNNSSVYYHRGQMNFILQNYDQAGKDFDKAKELDPENIFPYIQLACLAYRENKFDDCETLFSEAKRKFPEAPEVPNFFAEILTDKNDFDKALKQYDLAIELENKLDGIYVGIAPLVGKATLLTRNPTVENFIEATNLLEKASKLDPRSEQAKIGLAQMKLQQEDIDEAITLFEESADLARTMEEKLQAITFAEAAKVQQRIRSDPVLAKKIQETLAKLREQGLM

SEQ ID NO: 64 - protein, 499 aa, Saccharomyces cerevisiae
MSYNFTGTPTGEGTGGNSLTTDLNTQFDLANMGWIGVASAGVWIMVPGIGLLYSGLSRKKHALSLLWASMMASAVCIFQWFFWGYSLAFSHNTRGNGFIGTLEFFGFRNVLGAPSSVSSLPDILFAVYQGMFAAVTGALMLGGACERARLFPMMVFLFLWMTIVYCPIACWVWNAEGWLVKLGSLDYAGGLCVHLTSGHGGLVYALILGKRNDPVTRKGMPKYKPHSVTSVVLGTVFLWFGWMFFNGGSAGNATIRAWYSIMSTNLAAACGGLTWMVIDYFRCGRKWTTVGLCSGIIAGLVGITPAAGFVPIWSAVVIGVVTGAGCNLAVDLKSLLRIDDGLDCYSIHGVGGCIGSVLTGIFAADYVNATAGSYISPIDGGWINHHYKQVGYQLAGICAALAWTVTVTSILLLTMNAIPFLKLRLSADEEELGTDAAQIGEFTYEESTAYIPEPIRSKTSAQMPPPHENIDDKIVGNTDAEKNSTPSDASSTKNTDHIV

SEQ ID NO: 65 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 66 - protein, 1294 aa, Saccharomyces cerevisiae
MSQQENGDVATELIENRLSFSRIPRISLHVRDLSIVASKTNTTLVNTFSMDLPSGSVMAVMGGSGSGKTTLLNVLASKISGGLTHNGSIRYVLEDTGSEPNETEPKRAHLDGQDHPIQKHVIMAYLPQQDVLSPRLTCRETLKFAADLKLNSSERTKKLMVEQLIEELGLKDCADTLVGDNSHRGLSGGEKRRLSIGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGEALGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 67 - protein, 68 aa, Saccharomyces cerevisiae
MGAAYHFMGKAIPPHQLAIGTLGLLGLLVVPNPFKSAKPKTVDIKTDNKDEEKFIENYLKKHSEKQDA

SEQ ID NO: 68 - protein, 575 aa, Saccharomyces cerevisiae
MVNVGPSHAAVAVDASEARKRNISEEVFELRDKKDSTVVIEGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSEEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMSGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 69 - protein, 313 aa, Saccharomyces cerevisiae
MKFLGVILLASFLLIATFLIGLIPLYYIDKQKSSIVTNQEGADSISDFTTNADTQTINDDVSSYRVKIAVLSQFGIGMLLGTSFMLVIPEGIKACVEHDGNVGVNLLIGFLGVYVLDRLVTLWVSRKQTVYTHDAVKFQSWKDIINHPRQIWMNLIQNNVVFALFIHGLSDGIALGTTTNNDSLLIVVLIAIVIHKIPAVLSLTSLMVSRQNLMKWEVICNVFLFASSTPIGYIVLSLLNLSHSPTMDWISGNLLLMSGGSLLYASFTAFVGGDSHDHDLSVEQEVVLPHDESVYVLIGVCIPLVISYCISEE

SEQ ID NO: 70 - protein, 675 aa, Saccharomyces cerevisiae
MVSANGDLHLPISNEQCMPENNGSLGFEAPTPRQILRVTLNLKYLIDKVVPIVYDPNDIVCDHSEILSPKVVKLAYEACGGNPKDKANKRKYQSVIIFSLLKVCEWYSILATMEVHNAKLYETRNLASQQLCKLLIEREETRDLQFLFMQLLLRRYVINENDEDQEPLNALELATDMHCTTVIGSSGFQRCLKWIWRGWIVQNGLDPTTFIKDDSLAEVSLISHFNPVRLKAPVYQNYLQMIFSFLFLGLYTLVVNGKDSERVQSFDLLESIFYVFNTGFILDELTKLYYIGYAHLSFWNLFNDTTYLIITFAMGFRAMSVTPLNAKYSSEDWDKISYRVLSCAAPFVWSRLLLYLESQRFIGIMLVILKHMMKESIVFFFLLFLIMIGFTQGFLGLDSADGKRDITGPILGNLTITVLGLGSFDVFEEFAPPYAAILYYGYYFIVSVILLNILIALYSTAYQKVIDNADDEYMALMSQKTLRYIRAPDEDVYVSPLNLIEVFMTPIFRILPPKRAKDLSYTVMTIVYSPFLLLISVKETREARRIKYNRMKRLNDDANEYDTPWDLTDGYLDDDDGLFSDNRNSGMRATQLKNSRSLKLQRTAEQEDVHFKVPKKWYKNVKKCSPSFEQYDNDDTEDDAGEDKDEVKELTKKVENLTAVITDLLEKLDIKDKKE

SEQ ID NO: 71 - protein, 613 aa, Saccharomyces cerevisiae
MTHITLGQAIWASVRPIIKIYLIIGVGFGLCKMNILTVQATRSISDIVLTILLPCLSFNKIVANIEDNDIKDVGIICLTSVILFATGLGFAFIVRSVLPVPKRWRGGILAGGMFPNISDLPIAYLQSMDQGFIFTEAEGEKGVANVIIFLAMFLICVFNLGGFRLIENDFHYKGDDDEENTLTNDDSAQQPTQPIEGNSSSSSNQDILKEPNESTVPNSSQASYISEKNKKEKTELSVPKPTHTAPPAIDDRSSNSSAVVSIDSITHSLRTNHVDAQSVSELNDPTYRTRSQPIAYTTESRTSHVHNNRRNSITGSLRSIDMRELPAEGMSDLIREYSNVDQYGRRRKSSISSQGAPSVLQADGTISPNLTRTSTLQRVKTSNLTRIITSDATVSKKDIETSGSSLPKWLQKFPLTKFFVFFLKNCLRPCSMAVILALIIAFIPWVKALFVTTSNTPKIKQAPDNAPALTFIMDFTSYVGAASVPFGLILLGATLGRLKIGKLYPGFWKSAVVLVFLRQCIMPIFGVLWCDRLVKAGWLNWENDKMLLFVTAITWNLPTMTTLIYFTASYTPEDETEPVQMECTSFFLMLQYPLMVVSLPFLVSYFIKVQMKL

SEQ ID NO: 72 - protein, 292 aa, Saccharomyces cerevisiae
MEDSKKKGLIEGAILDIINGSIAGACGKVIEFPFDTVKVRLQTQASNVFPTTWSCIKFTYQNEGIARGFFQGIASPLVGACLENATLFVSYNQCSKFLEKHTNVSPLGQILISGGVAGSCASLVLTPVELVKCKLQVANLQVASAKTKHTKVLPTIKAIITERGLAGLWQGQSGTFIRESFGGVAWFATYEIVKKSLKDRHSLDDPKRDESKIWELLISGGSAGLAFNASIFPADTVKSVMQTEHISLTNAVKKIFGKFGLKGFYRGLGITLFRAVPANAAVFYIFETLSAL

SEQ ID NO: 73 - protein, 307 aa, Saccharomyces cerevisiae
MSSDSNAKPLPFIYQFISGAVAGISELTVMYPLDVVKTRFQLEVTTPTAAAVGKQVERYNGVIDCLKKIVKKEGFSRLYRGISSPMLMEAPKRATKFACNDQYQKIFKNLFNTNETTQKISIAAGASAGMTEAAVIVPFELIKIRMQDVKSSYLGPMDCLKKTIKNEGIMGLYKGIESTMWRNALWNGGYFGVIYQVRNSMPVAKTKGQKTRNDLIAGAIGGTVGTMLNTPFDVVKSRIQSVDAVSSAVKKYNWCLPSLLVIYREEGFRALYKGFVPKVCRLAPGGSLMLVVFTGMMNFFRDLKYGH

SEQ ID NO: 74 - protein, 1472 aa, Saccharomyces cerevisiae
MDIPSSNQIQHGQRSERNRRMPRASFSSTATTSTAATLTSAMVLDQNNSEPYAGATFEAVPSSIVSFHHPHSFQSSNLPSPHSSGNLEQRGRRLTESEPLVLSSAEQSRSSSRNPSHFRFFTQEQISNAEGASTLENTDYDMAWDATPAYEQDRIYGTGLSSRRSSIRSFSRASSLSNAKSYGSFSKRGRSGSRAPQRLGENSDTGFVYHSATHSSSSLSRYTTRERIPIELESQTDEILEDESSTHSLESSDSRRSASENNRGSFSGHDDVHNQHSEYLKPDYHEKFYPQYAPNLHYQRFYIAEEDLVIGIAAYQTSKFWYIIYNLCCFLTFGLVYLLTRWLPHLKVKLYGVKVPLAKAEWVVIENEFGEFVIQPIDRQWYNRPLSTVLPFENYPNPSYEPNDINLSHHHANEINPNVPILITFEYRYIKFIYSPLDDLFKTNNNWIDPDWVDLSTVSNGLTKGVQEDRELAFGKNQINLRMKTTSEILFNEVLHPFYVFQVFSIILWGIDEYYYYAACIFLISVLSIFDSLNEQKKVSRNLAEMSHFHCDVRVLRDKFWTTISSSELVPGDIYEVSDPNITILPCDSILLSSDCIVNESMLTGESVPVSKFPATEETMYQLCDDFQSTQISSFVSKSFLYNGTNIIRARIAPGQTAALAMVVRTGFSTTKGSLVRSMVFPKPTGFKFYRDSFKYIGFMSLIAIFGFCVSCVQFIKLGLDKKTMILRALDIITIVVPPALPATLTIGTNFALSRLKEKGIFCISPTRLNISGKIDVMCFDKTGTLTEDGLDVLGVQISEPNGVRGQKFGELLSDIRQVFPKFSLNDCSSPLDFKSRNFFMSLLTCHSLRSVDGNLLGDPLDFKMFQFTGWSFEEDFQKRAFHSLYEGRHEDDVFPENSEIIPAVVHPDSNNRENTFTDNDPHNFLGVVRSFEFLSELRRMSVIVKTNNDDVYWSFTKGAPEVISEICNKSTLPADFEEVLRCYTHNGYRVIACAGKTLPKRTWLYSQKVSREEVESNLEFLGFIIFQNKLKKETSETLKSLQDANIRTIMCTGDNILTAISVGREAGLIQCSRVYVPSINDTPLHGEPVIVWRDVNEPDKILDTKTLKPVKLGNNSVESLRECNYTLAVSGDVFRLLFRDENEIPEEYLNEILLNSSIYARMSPDEKHELMIQLQKLDYTVGFCGDGANDCGALKAADVGISLSEAEASVAAPFTSKIFNISCVLDVIREGRAALVTSFACFQYMSLYSAIQFITITILYSRGSNLGDFQFLYIDLLLIVPIAICMSWSKSYEKIDKKRPSANLVSPKILVPLLISVFLVFLFQFIPWIIVQKMSWYIKPIVGGDDAVQSSDNTVLFFVSNFQYILTAIVLSVGPPYREPMSKNFEFIVDITVSIGASLLLMTLDTESYLGKMLQLTPISNSFTMFIIVWVILNYYAQLYIPPSIKGWLKKKKSSKKYKLLIQEEMKLKEV

SEQ ID NO: 75 - protein, 521 aa, Saccharomyces cerevisiae
MSSDSLTPKDTIVPEEQTNQLRQPDLDEDSIHYDPEADDLESLETTASYASTSVSAKVYTKKEVNKGTDIESQPHWGENTSSTHDSDKEEDSNEEIESFPEGGFKAWVVTFGCFLGLIACFGLLNSTGVIESHLQDNQLSSESVSTIGWLFSLFLFVCSASCIISGTYFDRNGFRTIMIVGTVFHVAGLFATANSTKYWHFILSFAIVCGFGNGIVLSPLVSVPAHYFFKRRGTALAMATIGGSVGGVVFPIMLRSFFSMKSDTDPTYGFVWGIRTLGFLDLALLTLSIILVKERLPHVIENSKDGESRWRYILRVYILQCFDAKAFLDMKYLFCVLGTVFSELSINSALTYYGSYATSHGISANDAYTLIMIINVCGIPGRWVPGYLSDKFGRFNVAIATLLTLFIVMFVGWLPFGTNLTNMYVISALYGFCSGSVFSLLPVCCGQISKTEEFGKRYSTMYFVVGFGTLVGIPITGAIISIKTTADYQHYIIFCGLATFVSAVCYIISRAYCVGFKWVRF

SEQ ID NO: 76 - protein, 439 aa, Saccharomyces cerevisiae
MKLGSKQVKIISLLLLDTVFFGIEITTGYLSHSLALIADSFHMLNDIISLVVALWAVNVAKNRNPDSTYTYGWKRAEILGALINAVFLIALCVSILIEALQRIIAPPVIENPKFVLYVGVAGLISNTVGLFLFHDNDQEHGHGHGHSHGGIFADHEMHMPSSHTHTHAHVDGIENTTPMDSTDNISEIMPNAIVDSFMNENTRLLTPENASKTPSYSTSSHTIASGGNYTEHNKRKRSLNMHGVFLHVLGDALGNIGVMLSAFFIWKTDYSWKYYTDPLVSLIITGIIFSSALPLSCKASKILLQATPSTLSGDQVEGDLLKIPGIIAIHDFHIWNLTESIFIASLHIQLDISPEQFTDLAKIVRSKLHRYGIHSATLQPEFITREVTSTERAGDSQGDHLQNDPLSLRPKTYGTGISGSTCLIDDAANCNTADCLEDH

SEQ ID NO: 77 - protein, 470 aa, Saccharomyces cerevisiae
MNRRLLVRSISCFQPLSRITFGRPNTPFLRKYADTSTAANTNSTILRKQLLSLKPISASDSLFISCTVFNSKGNIISMSEKFPKWSFLTEHSLFPRDLRKIDNSSIDIIPTIMCKPNCIVINLLHIKALIERDKVYVFDTTNPSAAAKLSVLMYDLESKLSSTKNNSQFYEHRALESIFINVMSALETDFKLHSQICIQILNDLENEVNRLKLRHLLIKSKDLTLFYQKTLLIRDLLDELLENDDDLANMYLTVKKSPKDNFSDLEMLIETYYTQCDEYVQQSESLIQDIKSTEEIVNIILDANRNSLMLLELKVTIYTLGFTVASVLPAFYGMNLKNFIEESEWGFTSVAVFSIVSALYITKKNFNSLRSVTKMTMYPNSPANSSVYPKTSASIALTNKLKRRRKWWKSTKQRLGVLLYGSSYTNKANLSNNKINKGFSKVKKFNMENDIKNKQNRDMIWKWLIEDKKN

SEQ ID NO: 78 - protein, 244 aa, Saccharomyces cerevisiae
MSMSMGVRGLALRSVSKTLFSQGVRCPSMVIGARYMSSTPEKQTDPKAKANSIINAIPGNNILTKTGVLGTSAAAVIYAISNELYVINDESILLLTFLGFTGLVAKYLAPAYKDFADARMKKVSDVLNASRNKHVEAVKDRIDSVSQLQNVAETTKVLFDVSKETVELESEAFELKQKVELAHEAKAVLDSWVRYEASLRQLEQRQLAKSVISRVQSELGNPKFQEKVLQQSISEIEQLLSKLK

SEQ ID NO: 79 - protein, 773 aa, Saccharomyces cerevisiae
MLNGRLPLLRLGICRNMLSRPRLAKLPSIRFRSLVTPSSSQLIPLSRLCLRSPAVGKSLILQSFRCNSSKTVPETSLPSASPISKGSARSAHAKEQSKTDDYKDIIRLFMLAKRDWKLLLTAILLLTISCSIGMSIPKVIGIVLDTLKTSSGSDFFDLKIPIFSLPLYEFLSFFTVALLIGCAANFGRFILLRILSERVVARLRANVIKKTLHQDAEFFDNHKVGDLISRLGSDAYVVSRSMTQKVSDGVKALICGVVGVGMMCSLSPQLSILLLFFTPPVLFSASVFGKQIRNTSKDLQEATGQLTRVAEEQLSGIKTVQSFVAEGNELSRYNVAIRDIFQVGKTAAFTNAKFFTTTSLLGDLSFLTVLAYGSYLVLQSQLSIGDLTAFMLYTEYTGNAVFGLSTFYSEIMQGAGAASRLFELTDRKPSISPTVGHKYKPDRGVIEFKDVSFSYPTRPSVQIFKNLNFKIAPGSSVCIVGPSGRGKSTIALLLLRYYNPTTGTITIDNQDISKLNCKSLRRHIGIVQQEPVLMSGTIRDNITYGLTYTPTKEEIRSVAKQCFCHNFITKFPNTYDTVIGPHGTLLSGGQKQRIAIARALIKKPTILILDEATSALDVESEGAINYTFGQLMKSKSMTIVSIAHRLSTIRRSENVIVLGHDGSVVEMGKFKELYANPTSALSQLLNEKAAPGPSDQQLQIEKVIEKEDLNESKEHDDQKKDDNDDNDNNHDNDSNNQSPETKDNNSDDIEKSVEHLLKDAAKEANPIKITPQP

SEQ ID NO: 80 - protein, 587 aa, Saccharomyces cerevisiae
MDILKRGNESDKFTKIETESTTIPNDSDRSGSLIRRMKDSFKQSNLHVIPEDLENSEQTEQEKIQWKLASQPYQKVLSQRHLTMIAIGGTLGTGLFIGLGYSLASGPAALLIGFLLVGTSMFCVVQSAAELSCQFPVSGSYATHVSRFIDESVGFTVATNYALAWLISFPSELIGCALTISYWNQTVNPAVWVAIFYVFIMVLNLFGVRGFAETEFALSIIKVIAIFIFIIIGIVLIAGGGPNSTGYIGAKYWHDPGAFAKPVFKNLCNTFVSAAFSFGGSELVLLTSTESKNISAISRAAKGTFWRIAIFYITTVVIIGCLVPYNDPRLLSGSNSEDVSASPFVIALSNTGSMGAKVSNFMNVVILVAVVSVCNSCVYASSRLIQALGASGQLPSVCSYMDRKGRPLVGIGISGAFGLLGFLVASKKEDEVFTWLFALCSISSFFTWFCICMSQIRFRMALKAQGRSNDEIAYKSILGVYGGILGCVLNALLIAGEIYVSAAPVGSPSSAEAFFEYCLSIPIMIVVYFAHRFYRRDWKHFYIKRSEIDLDTGCSVENLELFKAQKEAEEQLIASKPFYYKIYRFWC

SEQ ID NO: 81 - protein, 754 aa, Saccharomyces cerevisiae
MTSNNSLLGRGRMSYSSTAPPRFKRSVDQRDTFSDNFDYDKDSSNRGRTYIAASNSTTGVPPPNNSRSGCTNNTNNTNNTSNTSNTNNNDSVDENTVFETLPYYLPCFSWLPEYTFNKLWGDVIAGISVASFQIPLALSYTTSIAHVPPLCGLYSLAISPFVYGILGSVPQMIVGPESAISLVVGQAVESITLHKENVSLIDISTVITFVSGTILLFSGISRFGFLGNVLSKALLRGFISSVGLVMIINSLISELKLDKFLVSLPQHYHTPFEKILFLIDYAPAQYHIPTAIFSGCCLIVLFLTRLLKRKLMKYHKSAIFFPDILLVVIVTILISMKFNLKHRYGISIIGDFSMDNFDELKNPLTRPRRKLIPDLFSASLIVAMLGFFESTTASKSLGTTYNLTVSSNRELVALGFMNIVISLFGALPAFGGYGRSKINALSGAQSVMSGVFMGVITLITMNLLLQFVHYIPNCVLSVITTIIGISLLEEVPGDIKFHLRCGGFSELFVFAVTFCTTIFYSIEAGICIGCVYSIINIIKHSAKSRIQILARVAGTSNFTNLDDYMMNMKRNSLDVEGTEEIEGCMIVRIPEPLTFTNSEDLKQRLDRIERYGSSKIHPGRKSLRSKDSIKYVIFDLGGMTSIDSSAAQVLEEIITSYKRRNVFIYLVNVSINDKVRRRLFKAGVAASVERAQANNNENNTSNTFSDAGETYSPYFDSIDAALYEIEKMKIKGNNVPNNDSESFMSNTLFNSSLV

SEQ ID NO: 82 - protein, 326 aa, Saccharomyces cerevisiae
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGNNGQEQLTNTQRLFSGALCGGCSVVATYPLDLIKTRLSIQTANLSSLNRSKAKSISKPPGIWQLLSETYRLEGGLRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRAEGVSGYYKGLAANLFKVVPSTAVSWLVYEVVCDSVRNW

SEQ ID NO: 83 - protein, 307 aa, Saccharomyces cerevisiae
MSEEFPSPQLIDDLEEHPQHDNARVVKDLLAGTAGGIAQVLVGQPFDTTKVRLQTSSTPTTAMEVVRKLLANEGPRGFYKGTLTPLIGVGACVSLQFGVNEAMKRFFHHRNADMSSTLSLPQYYACGVTGGIVNSFLASPIEHVRIRLQTQTGSGTNAEFKGPLECIKKLRHNKALLRGLTPTILREGHGCGTYFLVYEALIANQMNKRRGLERKDIPAWKLCIFGALSGTALWLMVYPLDVIKSVMQTDNLQKPKFGNSISSVAKTLYANGGIGAFFKGFGPTMLRAAPANGATFATFELAMRLLG

SEQ ID NO: 84 - protein, 328 aa, Saccharomyces cerevisiae
MLTLESALTGAVASAMANIAVYPLDLSKTIIQSQVSPSSSEDSNEGKVLPNRRYKNVVDCMINIFKEKGILGLYQGMTVTTVATFVQNFVYFFWYTFIRKSYMKHKLLGLQSLKNRDGPITPSTIEELVLGVAAASISQLFTSPMAVVATRQQTVHSAESAKFTNVIKDIYRENNGDITAFWKGLRTGLALTINPSITYASFQRLKEVFFHDHSNDAGSLSAVQNFILGVLSKMISTLVTQPLIVAKAMLQSAGSKFTTFQEALLYLYKNEGLKSLWKGVLPQLTKGVIVQGLLFAFRGELTKSLKRLIFLYSSFFLKHNGQRKLAST

SEQ ID NO: 85 - protein, 404 aa, Saccharomyces cerevisiae
MSEDQKSENSVPSKVNMVNRTDILTTIKSLSWLDLMLPFTIILSIIIAVIISVYVPSSRHTFDAEGHPNLMGVSIPLTVGMIVMMIPPICKVSWESIHKYFYRSYIRKQLALSLFLNWVIGPLLMTALAWMALFDYKEYRQGIIMIGVARCIAMVLIWNQIAGGDNDLCVVLVITNSLLQMVLYAPLQIFYCYVISHDHLNTSNRVLFEEVAKSVGVFLGIPLGIGIIIRLGSLTIAGKSNYEKYILRFISPWAMIGFHYTLFVIFISRGYQFIHEIGSAILCFVPLVLYFFIAWFLTFALMRYLSISRSDTQRECSCDQELLLKRVWGRKSCEASFSITMTQCFTMASNNFELSLAIAISLYGNNSKQAIAATFGPLLEVPILLILAIVARILKPYYIWNNRN

SEQ ID NO: 86 - protein, 548 aa, Saccharomyces cerevisiae
MVYTSTYRHTIVVDLLEYLGIVSNLETLQSAREDETRKPENTDKKECKPDYDIECGPNRSCSESSTDSDSSGSQIEKNDPFRVDWNGPSDPENPQNWPLLKKSLVVFQIMLLTCVTYMGSSIYTPGQEYIQEEFHVGHVVATLNLSLYVLGYGLGPIIFSPLSETARYGRLNLYMVTLFFFMIFQVGCATVHNIGGLIVMRFISGILCSPSLATGGGTVADIISPEMVPLVLGMWSAGAVAAPVLAPLLGAAMVDAKNWRFIFWLLMWLSAATFILLAFFFPETQHHNILYRRALKLRKETGDDRYYTEQDKLDREVDARTFLINTLYRPLKMIIKEPAILAFDLYIAVAYGCFYLFFEAFPIVFVGIYHFSLVEVGLAYMGFCVGCVLAYGLFGILNMRIIVPRFRNGTFTPEAFLIVAMCVCWCLPLSLFLFGWTARVHWILPVISEVFFVLAVFNIFQATFAYLATCYPKYVASVFAGNGFCRASFACAFPLFGRAMYDNLATKNYPVAWGSSLVGFLTLGLAIIPFILYKYGPSLRTRSSYTEE

SEQ ID NO: 87 - protein, 633 aa, Saccharomyces cerevisiae
MPDNLSLHLSGSSKRLNSRQLMESSNETFAPNNVDLEKEYKSSQSNITTEVYEASSFEEKVSSEKPQYSSFWKKIYYEYVVVDKSILGVSILDSFMYNQDLKPVEKERRVWSWYNYCYFWLAECFNINTWQIAATGLQLGLNWWQCWITIWIGYGFVGAFVVLASRVGSAYHLSFPISSRASFGIFFSLWPVINRVVMAIVWYSVQAYIAATPVSLMLKSIFGKDLQDKIPDHFGSPNATTYEFMCFFIFWAASLPFLLVPPHKIRHLFTVKAVLVPFASFGFLIWAIRRAHGRIALGSLTDVQPHGSAFSWAFLRSLMGCMANFSTMVINAPDFSRFSKNPNSALWSQLVCIPFLFSITCLIGILVTAAGYEIYGINYWSPLDVLEKFLQTTYNKGTRAGVFLISFVFAVAQLGTNISANSLSCGTDMSAIFPKFINIKRGSLFCAAMALCICPWNLMATSSKFTMALSAYAIFLSSIAGVVCSDYFVVRRGYIKLTHIYSHQKGSFYMYGNRFGINWRALAAYLCGVAPCLPGFIAEVGAPAIKVSDGAMKLYYLSYWVGYGLSFSSYTALCYFFPVPGCPVNNIIKDKGWFQRWANVDDFEEEWKDTIERDDLVDDNISVYEHEHEKTFI

SEQ ID NO: 88 - protein, 689 aa, Saccharomyces cerevisiae
MQAQGSQSNVGSLRSNCSDNSLPNNHVMMHCDESSGSPHSEHNDYSYEKTNLESTASNSREHRDNQLSRLKSEEYVVPKNQRRGLLPQLAIIPEFKDARDYPPMMKKMIVFLIAFSSMMGPMGTSIIFPAINSITTEFKTSVIMVNVSIGVYLLSLGVFPLWWSSLSELEGRRTTYITSFALLFAFNIGSALAPDINSFIALRMLCGAASASVQSVGAGTVADLYISEDRGKNLSYYYLGPLLAPLLSPIFGSLLVNRWPWRSTQWFMVILSGCNVILLTVLLPETLRKQDSKGAIAQILAERRIQVDNNERGEIQEDYQRGEDETDRIENQVATLSTEKHNYVGEVRDQDSLDLESHSSPNTYDGRAGETQLQRIYTEASRSLYEYQLDDSGIDATTAQVTRIRSTDPKLARSIRENSLRKLQTNLEEQVKKVLSSNGGEIAPKQVSAVRKVWDTFFVYFIKPLKSLHFLEYPPVALAITFSAISFSTVYFVNMTVEYKYSRPPYNFKPLYIGLLYIPNSVTYFFASIYGGRWVDMLLKRYKEKYGILAPEARISWNVVTSVISFPIALLIFGWCLDKKCHWVTPLIGTALFGYAAMMTIGATLSYLVDSLPGKGATGVALNNLIRQILAATAVFVTTPMLNGMGTGWAFTMLAFIVLGASSVLIILKKHGDYWRENYDLQKLYDKID

SEQ ID NO: 89 - protein, 427 aa, Saccharomyces cerevisiae
MVETFSFAHLAYLVFESVLQVVIIALAGFWSASSGLLPKQSQKIISLLNVDLFTPCLIFSKLAKSLSMAKIFEIAIIPIFFGLTTGISFISGKIMSRILDLDKDETNFVVANSVFGNSNSLPVSLTLSLAYTLPNLTWDQIPNDNRDNVASRGILYLLIFQQIGQMLRWSWGYNKLMKWSGENTQHMPPSQVQSLLERTPNIDNEELVNEEQEEQELLEEENNRMNSSFLSSSSIGDKIWQKSCTVFERIRANLNPPLYSMIFAVVVAAIGPLQRELFMEDGFINNTFAEAVTQLGSVSIPLILVVLGSNLYPSAEVFPKTVHHSKLLIGSIIGRMILPSCFLLPIIAIAVKYINVSILDDPIFLVVGFLLTVSPPAIQLTQITQLNEFFEAEMADILFWGYAVLSLPVSIIVVSGAIYVLQWANPT

SEQ ID NO: 90 - protein, 1216 aa, Saccharomyces cerevisiae
MKPEKLFSGLGTSDGEYGVVNSENISIDAMQDNRGECHRRSIEMHANDNLGLVSQRDCTNRPKITPQECLSETEQICHHGENRTKAGLDVDDAETGGDHTNESRVDECCAEKVNDTETGLDVDSCCGDAQTGGDHTNESCVDGCCVRDSSVMVEEVTGSCEAVSSKEQLLTSFEVVPSKSEGLQSIHDIRETTRCNTNSNQHTGKGRLCIESSDSTLKKRSCKVSRQKIEVSSKPECCNISCVERIASRSCEKRTFKGSTNVGISGSSSTDSLSEKFFSEQYSRMYNRYSSILKNLGCICNYLRTLGKESCCLPKVRFCSGEGASKKTKYSYRNSSGCLTKKKTHGDKERLSNDNGHADFVCSKSCCTKMKDCAVTSTISGHSSSEISRIVSMEPIENHLNLEAGSTGTEHIVLSVSGMSCTGCESKLKKSFGALKCVHGLKTSLILSQAEFNLDLAQGSVKDVIKHLSKTTEFKYEQISNHGSTIDVVVPYAAKDFINEEWPQGVTELKIVERNIIRIYFDPKVIGARDLVNEGWSVPVSIAPFSCHPTIEVGRKHLVRVGCTTALSIILTIPILVMAWAPQLREKISTISASMVLATIIQFVIAGPFYLNALKSLIFSRLIEMDLLIVLSTSAAYIFSIVSFGYFVVGRPLSTEQFFETSSLLVTLIMVGRFVSELARHRAVKSISVRSLQASSAILVDKTGKETEINIRLLQYGDIFKVLPDSRIPTDGTVISGSSEVDEALITGESMPVPKKCQSIVVAGSVNGTGTLFVKLSKLPGNNTISTIATMVDEAKLTKPKIQNIADKIASYFVPTIIGITVVTFCVWIAVGIRVEKQSRSDAVIQAIIYAITVLIVSCPCVIGLAVPIVFVIASGVAAKRGVIFKSAESIEVAHNTSHVVFDKTGTLTEGKLTVVHETVRGDRHNSQSLLLGLTEGIKHPVSMAIASYLKEKGVSAQNVSNTKAVTGKRVEGTSYSGLKLQGGNCRWLGHNNDPDVRKALEQGYSVFCFSVNGSVTAVYALEDSLRADAVSTINLLRQRGISLHILSGDDDGAVRSMAARLGIESSNIRSHATPAEKSEYIKDIVEGRNCDSSSQSKRPVVVFCGDGTNDAIGLTQATIGVHINEGSEVAKLAADVVMLKPKLNNILTMITVSQKAMFRVKLNFLWSFTYNLFAILLAAGAFVDFHIPPEYAGLGELVSILPVIFVAILLRYAKI

SEQ ID NO: 91 - protein, 574 aa, Saccharomyces cerevisiae [sequence omitted]

SEQ ID NO: 92 - protein, 528 aa, Saccharomyces cerevisiae
MSYGTINDMNESVTNYRIKKAQNNIKGWYAYSFSSEPFVVSAVSTYIPLLLQQFASINGVKVHDHSIPCLSETGSDSDKCVLGLFNNRIFVDTSSFALYVFSLSVLFQTIIVISVSGIVDLWGSVKFKGRILVWFGIVGALSTVAISKLNDTQIYSLAGLYIVANGCFGVINVVGNSLLPIFVKDSLKCQSQGAYEPDKVDSLTTVISGRGASLGYSSALIVQIVSMFLVASKKGSKQDVQVAVLFVGIWWFVWQLPMIWLIDDVTIPIRVDDSTLASARSPYPGEQDALGQLNWKNYLSYGWVSLFESFKHARLLKDVMIFLIAWFIISDSITTINSTAVLFSKAELHMSTLNLIMISVLTVVNAMLGAFMIPQFLATKFRWTSSQTLMYIIIWASFIPFYGILGFFFNAFGLKHKFEMFLLAIWYGLSLGGLSAVSRSVFSLIVPPGKESTFFSMFSITDKGSSILGPFLVGLLTDKTHNIRYSFYFFFLLLMLSLPVLNCLDVKRGRREAEELSQVLPESERRLD

SEQ ID NO: 93 - protein, 1049 aa, Saccharomyces cerevisiae
MGSHRRYLYYSILSFLLLSCSVVLAKQDKTPFFEGTSSKNSRLTAQDKGNDTCPPCFNCMLPIFECKQFSECNSYTGRCECIEGFAGDDCSLPLCGGLSPDESGNKDRPIRAQNDTCHCDNGWGGINCDVCQEDFVCDAFMPDPSIKGTCYKNGMIVDKVFSGCNVTNEKILQILNGKIPQITFACDKPNQECNFQFWIDQLESFYCGLSDCAFEYDLEQNTSHYKCNDVQCKCVPDTVLCGAKGSIDISDFLTETIKGPGDFSCDLETRQCKFSEPSMNDLILTVFGDPYITLKCESGECVHYSEIPGYKSPSKDPTVSWQGKLVLALTAVMVLALFTFATFYISKSPLFRNGLGSSKSPIRLPDEDAVNNFLQNEDDTLATLSFENITYSVPSINSDGVEETVLNEISGIVKPGQILAIMGGSGAGKTTLLDILAMKRKTGHVSGSIKVNGISMDRKSFSKIIGFVDQDDFLLPTLTVFETVLNSALLRLPKALSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNAKKVSEFLRNEGYICPDNYNIADYLIDITFEAGPQGKRRRIRNISDLEAGTDTNDIDNTIHQTTFTSSDGTTQREWAHLAAHRDEIRSLLRDEEDVEGTDGRRGATEIDLNTKLLHDKYKDSVYYAELSQEIEEVLSEGDEESNVLNGDLPTGQQSAGFLQQLSILNSRSFKNMYRNPKLLLGNYLLTILLSLFLGTLYYNVSNDISGFQNRMGLFFFILTYFGFVTFTGLSSFALERIIFIKERSNNYYSPLAYYISKIMSEVVPLRVVPPILLSLIVYPMTGLNMKDNAFFKCIGILILFNLGISLEILTIGIIFEDLNNSIILSVLVLLGSLLFSGLFINTKNITNVAFKYLKNFSVFYYAYESLLINEVKTLMLKERKYGLNIEVPGATILSTFGFVVQNLVFDIKILALFNVVFLIMGYLALKWIVVEQK

SEQ ID NO: 94 - protein, 486 aa, Saccharomyces cerevisiae
MPLSKVEHYLSYHTRLLLPHVLSLQSSHRVAYIFSLLSAVSTGFITLISLYSQPWQKHLNYSSWQINTIASMTNLGMYLTPPILGMIADSHGPITLSLLAIIGFIPSYSYLAYVFNHPELSLGGNGDSSFNLSIICFVFIGISTSALYFSALLTCTKLYPHTKLLSISLPTTCYGISSVVGSQLLRIKWFWSSNASSSSSNSDLNLGRVFQTFALVYVVIGLLAWIATSVVSLLHFNEEQDNQKRLDDQTDVEQSPLLERSNHVQEKFTQTMLRIFSDPVTYILAVSILLSLGPLEMFIANMGSLTNLLVQLDAPTLSTKLLSTYALSSTFTRLLTGIVADFFAKKKISIKWILLTFLSLGVCAQLFLLKMTSSASPWGLVPTGSLVGIVYGGLFTVYPTLVLLVWGERSFGTVYGSLLIAPAIGSMIFCMLYAKFYDSRCMSGGGDLRNPSCISAVYKYSSIAFVVSAVLSAVVFWKLKSRKLRI

SEQ ID NO: 95 - protein, 354 aa, Saccharomyces cerevisiae
MDLTVEPNLHSLITSTTHKWIFVGGKGGVGKTTSSCSIAIQMALSQPNKQFLLISTDPAHNLSDAFGEKFGKDARKVTGMNNLSCMEIDPSAALKDMNDMAVSRANNNGSDGQGDDLGSLLQGGALADLTGSIPGIDEALSFMEVMKHIKRQEQGEGETFDTVIFDTAPTGHTLRFLQLPNTLSKLLEKFGEITNKLGPMLNSFMGAGNVDISGKLNELKANVETIRQQFTDPDLTTFVCVCISEFLSLYETERLIQELISYDMDVNSIIVNQLLFAENDQEHNCKRCQARWKMQKKYLDQIDELYEDFHVVKMPLCAGEIRGLNNLTKFSQFLNKEYNPITDGKVIYELEDKE

SEQ ID NO: 96 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 97 - protein, 609 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPLKTSLITTPREISKLPLQRNSNVSHHL

SEQ ID NO: 98 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKVESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 99 - protein, 621 aa, Saccharomyces cerevisiae
MFDQLAVFTPQGQVLYQYNCLGKKFSEIQINSFISQLITSPVTRKESVANANTDGFDFNLLTINSEHKNSPSFNALFYLNKQPELYFVVTFAEQTLELNQETQQTLALVLKLWNSLHLSESILKNRQGQNEKNKHNYVDILQGIEDDLKKFEQYFRIKYEESIKQDHINPDNFTKNGSVPQSHNKNTKKKLRDTKGKKQSTGNVGSGRKWGRDGGMLDEMNHEDAAKLDFSSSNSHNSSQVALDSTINKDSFGDRTEGGDFLIKEIDDLLSSHKDEITSGNEAKNSGYVSTAFGFLQKHVLGNKTINESDLKSVLEKLTQQLITKNVAPEAADYLTQQVSHDLVGSKTANWTSVENTARESLTKALTQILTPGVSVDLLREIQSKRSKKDEEGKCDPYVFSIVGVNGVGKSTNLSKLAFWLLQNNFKVLIVACDTFRSGAVEQLRVHVENLAQLMDDSHVRGSKNKRGKTGNDYVELFEAGYGGSDLVTKIAKQAIKYSRDQNFDIVLMDTAGRRHNDPTLMSPLKSFADQAKPDKIIMVGEALVGTDSVQQAKNFNDAFGKGRNLDFFIISKCDTVGEMLGTMVNMVYATGIPILFVGVGQTYTDLRTLSVKWAVNTLMS

SEQ ID NO: 100 - protein, 584 aa, Saccharomyces cerevisiae
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 101 - protein, 335 aa, Saccharomyces cerevisiae
MNNGDNKTTLENSKNASLANGNYAIPTKLNRLKKNADPRVAAISGALSGALSAMLVCPFDVAKTRLQAQGLQNMTHQSQHYKGFFGTFATIFKDEGAAGLYKGLQPTVLGYIPTLMIYFSVYDFCRKYSVDIFPHSPFLSNASSAITAGAISTVATNPIWVVKTRLMLQTGIGKYSTHYKGTIDTFRKIIQQEGAKALYAGLVPALLGMLNVAIQFPLYENLKIRFGYSESTDVSTDVTSSNFQKLILASMLSKMVASTVTYPHEILRTRMQLKSDLPNTVQRHLLPLIKITYRQEGFAGFYSGFATNLVRTVPAAVVTLVSFEYSKKYLTTFFQ

SEQ ID NO: 102 - protein, 160 aa, Saccharomyces cerevisiae
MTELCPVYAPFFGAIGCASAIIFTSLGAAYGTAKSGVGICATCVLRPDLLFKNIVPVIMAGIIAIYGLVVSVLVCYSLGQKQALYTGFIQLGAGLSVGLSGLAAGFAIGIVGDAGVRGSSQQPRLFVGMILILIFAEVLGLYGLIVALLLNSRATQDVVC

SEQ ID NO: 103 - protein, 628 aa, Saccharomyces cerevisiae
MDPGIANHTLPEEFEEVVVPEMLEKEVGAKVDVKPTLTTSSPAPSYIELIDPGVHNIEIYAEMYNRPIYRVALFFSLFLIAYAYGLDGNIRYTFQAYATSSYSQHSLLSTVNCIKTVIAAVGQIFFARLSDIFGRFSIMIVSIIFYSMGTIIESQAVNITRFAVGGCFYQLGLTGIILILEVIASDFSNLNWRLLALFIPALPFIINTWISGNVTSAIDANWKWGIGMWAFILPLACIPLGICMLHMRYLARKHAKDRLKPEFEALNKLKWKSFCIDIAFWKLDIIGMLLITVFFGCVLVPFTLAGGLKEEWKTAHIIVPEVIGWVVVLPLYMLWEIKYSRHPLTPWDLIQDRGIFFALLIAFFINFNWYMQGDYMYTVLVVAVHESIKSATRITSLYSFVSVIVGTILGFILIKVRRTKPFIIFGISCWIVSFGLLVHYRGDSGAHSGIIGSLCLLGFGAGSFTYVTQASIQASAKTHARMAVVTSLYLATYNIGSAFGSSVSGAVWTNILPKEISKRISDPTLAAQAYGSPFTFITTYTWGTPERIALVMSYRYVQKILCIIGLVFCFPLLGCAFMLRNHKLTDSIALEGNDHLESKNTFEIEEKEESFLKNKFFTHFTSSKDRKD

SEQ ID NO: 104 - protein, 88 aa, Saccharomyces cerevisiae
MAASVPPGGQRILQKRRQAQSIKEKQAKQTPTSTRQAGYGGSSSSILKLYTDEANGFRVDSLVVLFLSVGFIFSVIALHLLTKFTHII

SEQ ID NO: 105 - protein, 300 aa, Saccharomyces cerevisiae
MESNKQPRKIQLYTKEFYATCTLGGIIACGPTHSSITPLDLVKCRLQVNPKLYTSNLQGFRKIIANEGWKKVYTGFGATFVGYSLQGAGKYGGYEYFKHLYSSWLSPGVTVYLMASATAEFLADIMLCPFEAIKVKQQTTMPPFCNNVVDGWKKMYAESGGMKAFYKGIVPLWCRQIPYTMCKFTSFEKIVQKIYSVLPKKKEEMNALQQISVSFVGGYLAGILCAAVSHPADVMVSKINSERKANESMSVASKRIYQKIGFTGLWNGLMVRIVMIGTLTSFQWLIYDSFKAYVGLPTTG

SEQ ID NO: 106 - protein, 448 aa, Saccharomyces cerevisiae
MVASIRSGVLTLLHTACGAGILAMPYAFKPFGLIPGVIMIVLCGACAMQSLFIQARVAKYVPQGRASFSALTRLINPNLGIVFDLAIAIKCFGVGVSYMIVVGDLMPQIMSVWTRNAWLLNRNVQISLIMLFFVAPLSFLKKLNSLRYASMVAISSVAYLCVLVLLHYVAPSDEILRLKGRISYLLPPQSHDLNVLNTLPIFVFAYTCHHNMFSIINEQRSSRFEHVMKIPLIAISLALILYIAIGCAGYLTFGDNIIGNIIMLYPQAVSSTIGRIAIVLLVMLAFPLQCHPARASIHQILQHFAEENVSISATSADEPTVATESSPLIRDSSLDLNEVIEEESIYQPKETPLRGKSFIVITCSILVASYLVAISVSSLARVLAIVGATGSTSISFILPGLFGYKLIGTEHKTAVPLTTKIFKYTGLLLFIWGLIIMITCLTAALKLN

SEQ ID NO: 107 - protein, 289 aa, Saccharomyces cerevisiae
MVSQFAIEVRNLTYKFKESSDPSVVDINLQIPWNTRSLVVGANGAGKSTLLKLLSGKHLCLDGKILVNGLDPFSPLSMNQVDDDESVEDSTNYQTTTYLGTEWCHMSIINRDIGVLELLKSIGFDHFRERGERLVRILDIDVRWRMHRLSDGQKRRVQLAMGLLKPWRVLLLDEVTVDLDVIARARLLEFLKWETETRRCSVVYATHIFDGLAKWPNQVYHMKSGKIVDNLDYQKDVEFSEVVNAKVNGQVAFENDNNKVVISKVNSLHPLALEWLKRDNQIPDKEIGI

SEQ ID NO: 108 - protein, 309 aa, Saccharomyces cerevisiae
MANQNSDLYKQITAGSVAAVFQTTMTYPFEYLKTGLQLQPKGTAFEIILPQIKSYFVGCSALNVAAFGKTILRFVTFDKLCHSLNNNIDNNDNFQRLTGYNLLIAGTLTGIVESLFIIPFENIKTTLIQSAMIDHKKLEKNQPVVNAKATFHKVATKSTPVARIEKLLPAVKHMYQTRGPAAFVQGTTATIFRQIANTSIQFTAYTAFKRLLQARNDKASSVITGLATSFTLVAMTQPIDVVKTRMMSQNAKTEYKNTLNCMYRIFVQEGMATFWKGSIFRFMKVGISGGLTFTVYEQVSLLLGFSSRS

SEQ ID NO: 109 - protein, 560 aa, Saccharomyces cerevisiae
MSLISILSPLITSEGLDSRIKPSPKKDASTTTKPSLWKTTEFKFYYIAFLVVVPLMFYAGLQASSPENPNYARYERLLSQGWLFGRKVDNSDSQYRFFRDNFALLSVLMLVHTSIKRIVLYSTNITKLRFDLIFGLIFLVAAHGVNSIRILAHMLILYAIAHVLKNFRRIATISIWIYGISTLFINDNFRAYPFGNICSFLSPLDHWYRGIIPRWDVFFNFTLLRVLSYNLDFLERWENLQKKKSPSYESKEAKSAILLNERARLTAAHPIQDYSLMNYIAYVTYTPLFIAGPIITFNDYVYQSKHTLPSINFKFIFYYAVRFVIALLSMEFILHFLHVVAISKTKAWENDTPFQISMIGLFNLNIIWLKLLIPWRLFRLWALLDGIDTPENMIRCVDNNYSSLAFWRAWHRSYNKWVVRYIYIPLGGSKNRVLTSLAVFSFVAIWHDIELKLLLWGWLIVLFLLPEIFATQIFSHYTDAVWYRHVCAVGAVFNIWVMMIANLFGFCLGSDGTKKLLSDMFCTVSGFKFVILASVSLFIAVQIMFEIREEEKRHGIYLKC

SEQ ID NO: 110 - protein, 486 aa, Saccharomyces cerevisiae
MNRILSSASLLSNVSMPRQNKHKITKALCYAIIVASIGSIQFGYHLSELNAPQQVLSCSEFDIPMEGYPYDRTWLGKRGYKQCIPLNDEQIGIVTSVFCIGGILGSYFATSLANIYGRKFSSLINCTLNIVGSLIIFNSNSYRGLIIGRILVGISCGSLIVIIPLFIKEVAPSGWEGLLGSMTQICIRLGVLLTQGIALPLTDSYRWRWILFGSFLIAVLNFFMWFIVDESPKWLLAHGRVTDAKLSLCKLRGVTFDEAAQEIQDWQLQIESGDPLIEPTTTNSISGSNSLWKYLRDRTNVKSRHVITVLLFGQQFCGINSIVLYGTKIISQLYPQHAIRINFFISMVNVLVTILVSLLIHSLPRKPLLMTSTVLVSVTAFIMGIAMNHNKMNLLIVFSFIYMGVFTMGLNPLPFIIMREVSKPQDMVLAQRYGTICNWVGTFIIAYTFPIIHDVLSGYVFIIFAIIACSISAFIWKKVPETKRSG

SEQ ID NO: 111 - protein, 725 aa, Saccharomyces cerevisiae
MPQSTPSQEVQRVPWDNKPALKQITLRATIAGIAIGSLVLTSNFQFGLQTGWVSMMSLPSALLACAFFKNIWPLIFPNDRPFSDVENVYVQSMAVAVGTGPLAFGFVGVIPAIEKFLTNDESGGLREQGQSFTFRELLIWSTALAFFGIFFAVPLRKQVIVREKLPFPSGSATATLISVLNGTEILQEVSKSELLEMRQRRLNECPEVLQPNRDPEEADYLMNSSHSELGDYTATSQDGSSILSTGSENYRANIIILLKTFVVSSLYTMVSYFVPVIRSIPVFGKYLSNNYLWNFQPSPAYIGQGIIMGLPTVSYMLIGCFLGWGVLAPLARYKRWVPPDADVHDWEEGVQGWILWSSLSIMVADSVVAFIVVTVKSIVKFILIDDKAALLNNIIDDTFQSMLLEEERAINSSRRNTYVDGRQDTVRLVSRDNEIEVDSKHLVRYTTVISGCLVSSIICIVSIIYLFGIQVIPLYAIITALILALFLSILGIRALGETDLNPVSGIGKISQLIFAFIIPRDRPGSVLMNVVSGGIAEASAQQAGDLMQDLKTGHLLGASPRAQFCAQLIGACWSIILSSFMYLCYNKVYSIPSEQFRIPTAVVWIDCARLVTGKGLPDKALECSMILGVIFAVLSLIRNTYRDYGYGWILYIPSGVAVGVGIFNSPSFTIARFIGGWASHFWLKNHRGDLNAKTKMIVFSSGLVLGEGIFSVINMLFICLNVPHY

SEQ ID NO: 112 - protein, 950 aa, Saccharomyces cerevisiae
MSDNPFNASLLDEDSNREREILDATAEALSKPSPSLEYCTLSVDEALEKLDTDKNGGLRSSNEANNRRSLYGPNEITVEDDESLFKKFLSNFIEDRMILLLIGSAVVSLFMGNIDDAVSITLAIFIVVTVGFVQEYRSEKSLEALNKLVPAECHLMRCGQESHVLASTLVPGDLVHFRIGDRIPADIRIIEAIDLSIDESNLTGENEPVHKTSQTIEKSSFNDQPNSIVPISERSCIAYMGTLVKEGHGKGIVVGTGTNTSFGAVFEMMNNIEKPKTPLQLTMDKLGKDLSLVSFIVIGMICLVGIIQGRSWLEMFQISVSLAVAAIPEGLPIIVTVTLALGVLRMAKRKAIVRRLPSVETLGSVNVICSDKTGTLTSNHMTVSKLWCLDSMSNKLNVLSLDKNKKTKNSNGNLKNYLTEDVRETLTIGNLCNNASFSQEHAIFLGNPTDVALLEQLANFEMPDIRNTVQKVQELPFNSKRKLMATKILNPVDNKCTVYVKGAFERILEYSTSYLKSKGKKTEKLTEAQKATINECANSMASEGLRVFGFAKLTLSDSSTPLTEDLIKDLTFTGLIGMNDPPRPNVKFAIEQLLQGGVHIIMITGDSENTAVNIAKQIGIPVIDPKLSVLSGDKLDEMSDDQLANVIDHVNIFARATPEHKLNIVRALRKRGDVVAMTGDGVNDAPALKLSDIGVSMGRIGTDVAKEASDMVLTDDDFSTILTAIEEGKGIFNNIQNFLTFQLSTSVAALSLVALSTAFKLPNPLNAMQILWINILMDGPPAQSLGVEPVDHEVMKKPPRKRTDKILTHDVMKRLLTTAACIIVGTVYIFVKEMAEDGKVTARDTTMTFTCFVFFDMFNALACRHNTKSIFEIGFFTNKMFNYAVGLSLLGQMCAIYIPFFQSIFKTEKLGISDILLLLLISSSVFIVDELRKLWTRKKNEEDSTYFSNV

SEQ ID NO: 113 - protein, 366 aa, Saccharomyces cerevisiae
MSDRNTSNSLTLKERMLSAGAGSVLTSLILTPMDVVRIRLQQQQMIPDCSCDGAAEVPNAVSSGSKMKTFTNVGGQNLNNAKIFWESACFQELHCKNSSLKFNGTLEAFTKIASVEGITSLWRGISLTLLMAIPANMVYFSGYEYIRDVSPIASTYPTLNPLFCGAIARVFAATSIAPLELVKTKLQSIPRSSKSTKTWMMVKDLLNETRQEMKMVGPSRALFKGLEITLWRDVPFSAIYWSSYELCKERLWLDSTRFASKDANWVHFINSFASGCISGMIAAICTHPFDVGKTRWQISMMNNSDPKGGNRSRNMFKFLETIWRTEGLAALYTGLAARVIKIRPSCAIMISSYEISKKVFGNKLHQ

SEQ ID NO: 114 - protein, 1592 aa, Saccharomyces cerevisiae
MGTDPLIIRNNGSFWEVDDFTRLGRTQLLSYYLPLAIIASIGIFALCRSGLSRYVRSAECDLVNEYLFGAQEERKEDNSIERLLRNSNTQANYVNVKKQGRILKLRHFDITTIDVKQIDAKNHGGLTFSRPSTSDHLRKSSEIVLMSLQIIGLSFLRVTKINIELTNRDVTTLLLFWLILLSLSILRVYKRSTNLWAICFTAHTTIWISTWIPIRSVYIGNIDDVPSQIFYIFEFVITSTLQPIKLTSPIKDNSSIIYVRDDHTSPSREHISSILSCITWSWITNFIWEAQKNTIKLKDIWGLSMEDYSIFILKGFTRRNKHINNLTLALFESFKTYLLIGMLWVLVNSIVNLLPTILMKRFLEIVDNPNRSSSCMNLAWLYIIGMFICRLTLAICNSQGQFVSDKICLRIRAILIGEIYAKGLRRRLFTSPKTSSDSDSISANLGTIINLISIDSFKVSELANYLYVTVQAVIMIIVVVGLLFNFLGVSAFAGISIILVMFPLNFLLANLLGKFQKQTLKCTDQRISKLNECLQNIRIVKYFAWERNIINEIKSIRQKELRSLLKKSLVWSVTSFLWFVTPTLVTGVTFAICTFVQHEDLNAPLAFTTLSLFTLLKTPLDQLSNMLSFINQSKVSLKRISDFLRMDDTEKYNQLTISPDKNKIEFKNATLTWNENDSDMNAFKLCGLNIKFQIGKLNLILGSTGSGKSALLLGLLGELNLISGSIIVPSLEPKHDLIPDCEGLTNSFAYCSQSAWLLNDTVKNNIIFDNFYNEDRYNKVIDACGLKRDLEILPAGDLTEIGEKGITLSGGQKQRISLARAVYSSAKHVLLDDCLSAVDSHTAVWIYENCITGPLMKNRTCILVTHNVSLTLRNAHFAIVLENGKVKNQGTITELQSKGLFKEKYVQLSSRDSINEKNANRLKAPRKNDSQKIEPVTENINFDANFVNDGQLIEEEEKSNGAISPDVYKWYLKFFGGFKALTALFALYITAQILFISQSWWIRHWVNDTNVRINAPGFAMDTLPLKGMTDSSKNKHNAFYYLTVYFLIGIIQAMLGGFKTMMTFLSGMRASRKIFNNLLDLVLHAQIRFFDVTPVGRIMNRFSKDIEGVDQELIPYLEVTIFCLIQCASIIFLITVITPRFLTVAVIVFVLYFFVGKWYLTASRELKRLDSITKSPIFQHFSETLVGVCTIRAFGDERRFILENMNKIDQNNRAFFYLSVTVKWFSFRVDMIGAFIVLASGSFILLNIANIDSGLAGISLTYAILFTDGALWLVRLYSTFEMNMNSVERLKEYSSIEQENYLGHDEGRILLLNEPSWPKDGEIEIENLSLRYAPNLPPVIRNVSFKVDPQSKIGIVGRTGAGKSTIITALFRLLEPITGCIKIDGQDISKIDLVTLRRSITIIPQDPILFAGTIKSNVDPYDEYDEKKIFKALSQVNLISSHEFEEVLNSEERFNSTHNKFLNLHTEIAEGGLNLSQGERQLLFIARSLLREPKIILLDEATSSIDYDSDHLIQGIIRSEFNKSTILTIAHRLRSVIDYDRIIVMDAGEVKEYDRPSELLKDERGIFYSMCRDSGGLELLKQIAKQSSKMMK

SEQ ID NO: 115 - protein, 546 aa, Saccharomyces cerevisiae
MEPLLFNSGKANPSQDVFIDVEVGDITTKYGSTNTGSFSSMDTVEAQAIKAETARFMEVPQGRHLGVFSTVVLFVSRIMGSGIFAVPSVILLNTGGNKLIYFAIWVFSAAIAFAGLYLFLEFGSWIPKSGGRKNFLERSFERPRLLISVVFSCYSVLTGYALTGSIVFGKYVLSAFGVTDDSWSKYVSISFIIFAVLIHGVSVRHGVFIQNALGGLKLIMIVLMCFAGLYTLFFYKSTGQVAWDLPVTQVEKDSLLSVSSIATAFISSFFCFSGWDTVHTVTSEIKNPVKTLKVSGPLSLIICFVCYTMMNVAYLKVLTYEEIVSAGPLVGSVLFTKLFGPRVGGKFIAFSIAISAASNILVVIYSISRVNQEIFKEGYLPFSIHMSKNWPFDAPLPSISLCGFITIAWILILPKEGESFNYLVSMDGYGNQFFLLLVAIGLFIWRFKHKNEVPEIRASTFGVLAIITLSLYMLMAPFFADPSLNRVGFLPPYQIMSLLVIVACFFFWLVKFVLLPKFFHYKLLPKITYLHDGLIVTEWVKKPCLC

SEQ ID NO: 116 - protein, 357 aa, Saccharomyces cerevisiae
MTRDSPDSNDSYKHINKNTTQKTSFDRNSFDYIVRSGLAGGISGSCAKTLIAPLDRIKILFQTSNPHYTKYTGSLIGLVEAAKHIWINDGVRGFFQGHSATLLRIFPYAAVKFVAYEQIRNTLIPSKEFESHWRRLVSGSLAGLCSVFITYPLDLVRVRLAYETEHKRVKLGRIIKKIYKEPASATLIKNDYIPNWFCHWCNFYRGYVPTVLGMIPYAGVSFFAHDLLHDVLKSPFFAPYSVLELSEDDELERVQKKQRRPLRTWAELISGGLAGMASQTAAYPFEIIRRRLQVSALSPKTMYDHKFQSISEIAHIIFKERGVRGFFVGLSIGYIKVTPMVACSFFVYERMKWNFGI

SEQ ID NO: 117 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 118 - protein, 373 aa, Saccharomyces cerevisiae
MTQTDNPVPNCGLLPEQQYCSADHEEPLLLHEEQLIFPDHSSQLSSADIIEPIKMNSSTESIIGTTLRKKWVPLSSTQITALSGAFAGFLSGVAVCPLDVAKTRLQAQGLQTRFENPYYRGIMGTLSTIVRDEGPRGLYKGLVPIVLGYFPTWMIYFSVYEFSKKFFHGIFPQFDFVAQSCAAITAGAASTTLTNPIWVVKTRLMLQSNLGEHPTHYKGTFDAFRKLFYQEGFKALYAGLVPSLLGLFHVAIHFPIYEDLKVRFHCYSRENNTNSINLQRLIMASSVSKMIASAVTYPHEILRTRMQLKSDIPDSIQRRLFPLIKATYAQEGLKGFYSGFTTNLVRTIPASAITLVSFEYFRNRLENISTMVI

SEQ ID NO: 119 - protein, 563 aa, Saccharomyces cerevisiae
MTKQQTSVMRNASIAKEEREGSDNNNVDRSSSDAISDNDAERSNSHSEIDNESNFDMVPYSRFSHKQKMLLVVQCAFTGFFSTVAGSIYYPVLTIIERKFNITEELANVTIVVYFIFQGVAPSIMGGLADTFGRRPIVLWAILAYFCACIGLACAHNYAQILALRCLQAAGISPVIAINSGIMGDVTTKVERGGYVGLVAGFQVVGTAFGALIGAGLSSKWGWRAIFWFLAIGSGICLVFSTLLMPETKRTLVGNGSVTPRSFLNRSLILHVGSVKKTLHLDDPDPETLEPRTSVDFLAPLKILHIREIDILLSIAGLQFSTWTTHQTALTIVLSKKYNLSVAKIGLCFLPAGISTLTSIISAGRYLNWSYRTRKVKYNRWIKEQELQLMEKYKGDKNKVAELIHSNSHYAFNLVEARLHPAFVTLLLSSIGFTAFGWCISVKTPLAAVLCTSAFASLFSNCILTFSTTLIVDLFPSKASTATGCLNLFRCLLSAIFIAALTKMVEKMRYGGVFTFLSAITSSSSLLLFYLLKNGKQLSFDRIRANDKSAGRSVGKNSEKVST

SEQ ID NO: 120 - protein, 542 aa, Saccharomyces cerevisiae
MAGATSSIIRENDFEDELAESMQSYNRETADKLALTRTESVKPEPEITAPPHSRFSRSFKTVLIAQCAFTGFFSTIAGAIYYPVLSVIERKFDIDEELVNVTVVVYFVFQGLAPTFMGGFADSLGRRPVVLVAIVIYFGACIGLACAQTYAQIIVLRCLQAAGISPVIAINSGIMGDVTTRAERGGYVGYVAGFQVLGSAFGALIGAGLSSRWGWRAIFWFLAIGSGICFLASFLILPETKRNISGNGSVTPKSYLNRAPILVLPTVRKSLHLDNPDYETLELPTQLNLLAPFKILKAYEICILMLVAGLQFAMYTTHLTALSTALSKQYHLTVAKVGLCYLPSGICTLCSIVIAGRYLNWNYRRRLKYYQNWLGKKRSKLLEEHDNDLNLVQRIIENDPKYTFNIFKARLQPAFVTLLLSSSGFCAYGWCITVKAPLAAVLCMSGFASLFSNCILTFSTTLIVDLFPTKTSTATGCLNLFRCILSAVFIAALSKMVEKMKFGGVFTFLGALTSSSSILLFILLRKGKELAFKRKKQELGVN

SEQ ID NO: 121 - protein, 542 aa, Saccharomyces cerevisiae
MSVQKEEYDIVEKAQLSVSAESLTSDSESISHNPFDDFHKAERWRKVYESSGYEGLSKFDPEFTWTKDEEKKLVRKMDLKIFLWVFIMFAFLDLIRKNIARAVSDNFIVDLKMNTNDYNLGQTVYLVIFLASELPGNLLSKRFGPERVIPVQIVLWSVICITQAGLKNRGQFIATRCLLGMVQGGFIPDNILYLSYYYTGAELTFRLSFFWCAIPLFQILGSLLASGIIEMRGIHNLAGWQYLFIIEGFLSLSVGVASFYLMRRGPTQTGESAFHKGKSLFTEYEEKIMVNRILRDDPSKGDMSNRQPVTFKEILYTLTEFDLWPLFIQGITAFISLQTVGSYLSLILKSLNYSTFLSNILAIPGQALLLINLPLAALLSRKLKEKSLCVGIANVWVLPFIVSLVALPTDTNPWIKYILLTGILGLPYTHSILAGWVSEISNSVRSRTVGTALYNMSAQVGAIIASNMYRNDDKPYYTRGNKILLGFTCFNICMAVATKFYYISRNKYKDRKWNSMTKEEQINYLDTTKDKGMKRLDYRFIH

SEQ ID NO: 122 - protein, 314 aa, Saccharomyces cerevisiae
MVENSSSNNSTRPIPAIPMDLPDYEALPTHAPLYHQLIAGAFAGIMEHSVMFPIDALKTRIQSANAKSLSAKNMLSQISHISTSEGTLALWKGVQSVILGAGPAHAVYFGTYEFCKKNLIDSSDTQTHHPFKTAISGACATTASDALMNPFDTIKQRIQLNTSASVWQTTKQIYQSEGLAAFYYSYPTTLVMNIPFAAFNFVIYESSTKFLNPSNEYNPLIHCLCGSISGSTCAAITTPLDCIKTVLQIRGSQTVSLEIMRKADTFSKAASAIYQVYGWKGFWRGWKPRIVANMPATAISWTAYECAKHFLMTY

SEQ ID NO: 123 - protein, 567 aa, Saccharomyces cerevisiae
MSGVNNTSANDLSTTESNSNSVANAPSVKTEHNDSKNSLNLDATEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKQIRGTLVQLYQLMCTMGIFLGYCTNYGTKNYHNATQWRVGLGLCFAWTTFMVSGMMFVPESPRYLIEVGKDEEAKRSLSKSNKVSVDDPALLAEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDDRPIYKRFFSS

SEQ ID NO: 124 - protein, 174 aa, Saccharomyces cerevisiae
MSLAKSAANKLDWAKVISSLRITGSTATQLSSFKKRNDEARRQLLELQSQPTEVDFSHYRSVLKNTSVIDKIESYVKQYKPVKIDASKQLQVIESFEKHAMTNAKETESLVSKELKDLQSTLDNIQSARPFDELTVDDLTKIKPEIDAKVEEMVKKGKWDVPGYKDRFGNLNVM

SEQ ID NO: 125 - protein, 922 aa, Saccharomyces cerevisiae
MSLISALQTTDVESVQTSPEQITERKAVRVSTLQESLHSSEMHRAAPETPRSISNSVHKLKTIYSTYQQSGQPLSKEAIFRAKQKYGILNTPANYKTLGLGDSKSESVDLAARLASKRTKVSPDDCVETAIEQKARGEAFKVTFSKIPLTPPEDVPITVNLGLKGRRDFLTRLAAQKALAFSPSLDNSMKGTSDSSSVKKKRFSGAPIGNEFDANLVNPQHPAGFKSLDLSKVLDGAERRAISRVNDRLYPQKVNFKNGLQSSDQSGVSKANKEVFKKGTLEKLEHSAEQFLESHAGNERQRLSDQQYMCAKGAADAVKDLDPKTLEDPDFAAREAQKKLYIKQVASPVVLNEAQKLANRKLQDIDSRDTYMLLFGNQAYNKLAVNIALQHYSVKQEEKKKIYLGGGLWMTPEEVNAVAKKLISPVVNEIDERASRQRDVDKDIERRSRVLDQEYEDGNSMERAKEQNDGQLLLAMASKQQQEKEAKKAEEGQRYDQFVQKMNIKLQQKEKELENARENRENLRNELQERLSKNLSGENDELNDWNDACERDLKNSSIEHYYAVRSHFDNLGNSERGYDELLEERSKIQVEIERLVASIAEHKTAIHGFGETADAGGAIPAVQKQKIPTRKDLLDATVNDPLVISAEMAKEEAEMATEECMLKELQVDEMIIIRNIMLRECEKKLEEEKETAKRSRRGTEESKNNSNFSRDVIMSTPDNNEKVTPIGKSASPKDVVKSRFLSTYNTGKDIDSSASARSITGVSGVLDDGPKTPTSNKENELIDDEVKSYKVHQAVDGTGEDSIANKRDKSSRPAANSGGSITIEQFLFNKNADKQGLSKTESVTMKREPVVDQMDSKKGHDFTHCNDNGRRSFSGFSQGSIENDYSNEVTDDQDDQEGSEIRVRDSNDSNTSPKESFFKEVI

SEQ ID NO: 126 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 127 - protein, 692 aa, Saccharomyces cerevisiae
MNGKEVSSGSGRTQSNNNKKNNNGGSTGISHASGSPLTDGNGGNSNGNSRSRSRSRKSSGTTGGLLKKPPLLVNNEAVHASVPDASHTSCNNGTLEVSINNPEPHVVDAVARHLIRNPSNSLQLQGGDITRDLYKWTNDHPSSPSQYQYPSQPALSTSIPSQAPSFSNRKRSMSFSAASIASSSHLNNNSEANGNPLAAIGLAPAPMTHEEIRAPGGFRRSFIIQKRRKHNVDAPIPNFFTRNFIEFLTLYGHFAGEDLSEEEEEEEETEEEPEEEALETESTQLVSREHGRHPHKSSTVKAVLLLLKSFVGTGVLFLPKAFHNGGWGFSALCLLSCALISYGCFVSLITTKDKVGVDGYGDMGRILYGPKMKFAILSSIALSQIGFSAAYTVFTATNLQVFSENFFHLKPGSISLATYIFAQVLIFVPLSLTRNIAKLSGTALIADLFILLGLVYVYVYSIYYIAVNGVASDTMLMFNKADWSLFIGTAIFTFEGIGLLIPIQESMKHPKHFRPSLSAVMCIVAVIFISCGLLCYAAFGSDVKTVVLLNFPQDTSYTLTVQLLYALAILLSTPLQLFPAIRILENWTFPSNASGKYNPKVKWLKNYFRCAIVVLTSILAWVGANDLDKFVSLVGSFACIPLIYIYPPLLHYKASILSGTSRARLLLDLIVIVFGVAVMAYTSWQTIKMWSQ

SEQ ID NO: 128 - protein, 1290 aa, Saccharomyces cerevisiae
MNFLSFKTTKHYHIFRYVNIRNDYRLLMIMIIGTVATGLVPAITSILTGRVFDLLSVFVANGSHQGLYSQLVQRSMAVMALGAASVPVMWLSLTSWMHIGERQGFRIRSQILEAYLEEKPMEWYDNNEKLLGDFTQINRCVEELRSSSAEASAITFQNLVAICALLGTSFYYSWSLTLIILCSSPIITFFAVVFSRMIHVYSEKENSETSKAAQLLTWSMNAAQLVRLYCTQRLERKKFKEIILNCNTFFIKSCFFVAANAGILRFLTLTMFVQGFWFGSAMIKKGKLNINDVITCFHSCIMLGSTLNNTLHQIVVLQKGGVAMEKIMTLLKDGSKRNPLNKTVAHQFPLDYATSDLTFANVSFSYPSRPSEAVLKNVSLNFSAGQFTFIVGKSGSGKSTLSNLLLRFYDGYNGSISINGHNIQTIDQKLLIENITVVEQRCTLFNDTLRKNILLGSTDSVRNADCSTNENRHLIKDACQMALLDRFILDLPDGLETLIGTGGVTLSGGQQQRVAIARAFIRDTPILFLDEAVSALDIVHRNLLMKAIRHWRKGKTTIILTHELSQIESDDYLYLMKEGEVVESGTQSELLADPTTTFSTWYHLQNDYSDAKTIVDTETEEKSIHTVESFNSQLETPKLGSCLSNLGYDETDQLSFYEAIYQKRSNVRTRRVKVEEENIGYALKQQKNTESSTGPQLLSIIQIIKRMIKSIRYKKILILGLLCSLIAGATNPVFSYTFSFLLEGIVPSTDGKTGSSHYLAKWSLLVLGVAAADGIFNFAKGFLLDCCSEYWVMDLRNEVMEKLTRKNMDWFSGENNKASEISALVLNDLRDLRSLVSEFLSAMTSFVTVSTIGLIWALVSGWKLSLVCISMFPLIIIFSAIYGGILQKCETDYKTSVAQLENCLYQIVTNIKTIKCLQAEFHFQLTYHDLKIKMQQIASKRAIATGFGISMTNMIVMCIQAIIYYYGLKLVMIHEYTSKEMFTTFTLLLFTIMSCTSLVSQIPDISRGQRAASWIYRILDEKHNTLEVENNNARTVGIAGHTYHGKEKKPIVSIQNLTFAYPSAPTAFVYKNMNFDMFCGQTLGIIGESGTGKSTLVLLLTKLYNCEVGKIKIDGTDVNDWNLTSLRKEISVVEQKPLLFNGTIRDNLTYGLQDEILEIEMYDALKYVGIHDFVISSPQGLDTRIDTTLLSGGQAQRLCIARALLRKSKILILDECTSALDSVSSSIINEIVKKGPPALLTMVITHSEQMMRSCNSIAVLKDGKVVERGNFDTLYNNRGELFQIVSNQSS

SEQ ID NO: 129 - protein, 602 aa, Saccharomyces cerevisiae
MSNTSSYEKNNPDNLKHNGITIDSEFLTQEPITIPSNGSAVSIDETGSGSKWQDFKDSFKRVKPIEVDPNLSEAEKVAIITAQTPLKHHLKNRHLQMIAIGGAIGTGLLVGSGTALRTGGPASLLIGWGSTGTMIYAMVMALGELAVIFPISGGFTTYATRFIDESFGYANNFNYMLQWLVVLPLEIVSASITVNFWGTDPKYRDGFVALFWLAIVIINMFGVKGYGEAEFVFSFIKVITVVGFIILGIILNCGGGPTGGYIGGKYWHDPGAFAGDTPGAKFKGVCSVFVTAAFSFAGSELVGLAASESVEPRKSVPKAAKQVFWRITLFYILSLLMIGLLVPYNDKSLIGASSVDAAASPFVIAIKTHGIKGLPSVVNVVILIAVLSVGNSAIYACSRTMVALAEQRFLPEIFSYVDRKGRPLVGIAVTSAFGLIAFVAASKKEGEVFNWLLALSGLSSLFTWGGICICHIRFRKALAAQGRGLDELSFKSPTGVWGSYWGLFMVIIMFIAQFYVAVFPVGDSPSAEGFFEAYLSFPLVMVMYIGHKIYKRNWKLFIPAEKMDIDTGRREVDLDLLKQEIAEEKAIMATKPRWYRIWNFWC

SEQ ID NO: 130 - protein, 241 aa, Saccharomyces cerevisiae
MNMGGSSSTAAKKATCKISMLWNWYTIDTCFIARSWRNDTKGKFAGSCIGCFALVVVAQWLTRFSRQFDVELLKRQKIKHLASYSPEEYVVKCGEEDAKSDIEELQGFYNEPSWKTTLISLQKSFIYSFYVWGPRRLNEPEDDLLKKVLSCCTLITPVDLYPTFLDHMIRVTIFVLQWGLSYIIMLLFMYYNGYIIISCLIGAIVGRFIFCYEPLGSLGANGSAQGTVSYDKESDDRKCCL

SEQ ID NO: 131 - protein, 442 aa, Saccharomyces cerevisiae
MNRTVFLAFVFGWYFCSIALSIYNRWMFDPKDGLGIGYPVLVTTFHQATLWLLSGIYIKLRHKPVKNVLRKNNGFNWSFFLKFLLPTAVASAGDIGLSNVSFQYVPLTIYTIIKSSSIAFVLLFGCIFKLEKFHWKLALSVIIMFVGVALMVFKPSDSTSTKNDQALVIFGSFLVLASSCLSGLRWVYTQLMLRNNPIQTNTAAAVEESDGALFTENEDNVDNEPVVNLANNKMLENFGESKPHPIHTIHQLAPIMGITLLLTSLLVEKPFPGIFSSSIFRLDTSNGGVGTETTVLSIVRGIVLLILPGFAVFLLTICEFSILEQTPVLTVSIVGIVKELLTVIFGIIILSERLSGFYNWLGMLIIMADVCYYNYFRYKQDLLQKYHSVSTQDNRNELKGFQDFEQLGSKKIAPYSISVDLTNQEYELDMIAQNVSRSSQQV

SEQ ID NO: 132 - protein, 368 aa, Saccharomyces cerevisiae
MNSWNLSSSIPIIHTPHDHPPTSEGTPDQPNNNRKDDKLHKKRGDSDEDLSPIWHCVVSGGIGGKIGDSAMHSLDTVKTRQQGAPNVKKYRNMISAYRTIWLEEGVRRGLYGGYMAAMLGSFPSAAIFFGTYEYTKRTMIEDWQINDTITHLSAGFLGDFISSFVYVPSEVLKTRLQLQGRFNNPFFQSGYNYSNLRNAIKTVIKEEGFRSLFFGYKATLARDLPFSALQFAFYEKFRQLAFKIEQKDGRDGELSIPNEILTGACAGGLAGIITTPMDVVKTRVQTQQPPSQSNKSYSVTHPHVTNGRPAALSNSISLSLRTVYQSEGVLGFFSGVGPRFVWTSVQSSIMLLLYQMTLRGLSNAFPTD

SEQ ID NO: 133 - protein, 540 aa, Saccharomyces cerevisiae
MFSIFKKKTSVQGTDSEIDEKITVKAKDKVVVSTEDEEVTTIVSSTKSTQVTNDSPWQDPTYFSSFGKELMFIATCMLAQLLNQAGQTHALCIMNVLSKSFNSEANNQAWLMASFPLAAGSFILISGRLGDIYGLKKMLIVGYVIVIVWSIISGLSKYSNSDAFFITSRAFQGVGIAFILPNIMGLVGHVYKVGSFRKNIVISFIGACAPTGGMFGGLFGGLIVTEDPNQWPWVFYAFGIATFLSLLMAWYSIPNNVPTNIHGLSMDWTGSALAIIGLILFNFVWNQAPIVGWDKPYIIVLLIISVIFLVAFFVYESKYAEVPLLPRAMTKNRHMIMILLAVFLGWGSFGIWTFYYVSFQLNLRHYSPVWTGGTYFVFVIFGSMAAFFVAFSIKRLGPALLLCFSLMAFDAGSIMFSVLPVEQSYWKLNFAMQAILCFGMDLSFPASSIILSDGLPMQYQGMAGSLVNTVINYSASLCLGMGGTVEHQINKSGNDLLKGYRAAVYLGVGLASLGVVISVTYMLENLWNRHRKSEDRSLEA

SEQ ID NO: 134 - protein, 284 aa, Saccharomyces cerevisiae
MNTFFLSLLSGAAAGTSTDLVFFPIDTIKTRLQAKGGFFANGGYKGIYRGLGSAVVASAPGASLFFISYDYMKVKSRPYISKLYSQGSEQLIDTTTHMLSSSIGEICACLVRVPAEVVKQRTQVHSTNSSWQTLQSILRNDNKEGLRKNLYRGWSTTIMREIPFTCIQFPLYEYLKKTWAKANGQSQVEPWKGAICGSIAGGIAAATTTPLDFLKTRLMLNKTTASLGSVIIRIYREEGPAVFFSGVGPRTMWISAGGAIFLGMYETVHSLLSKSFPTAGEMRA

SEQ ID NO: 135 - protein, 611 aa, Saccharomyces cerevisiae
MGRFSNIITSNKWDEKQNNIGEQSMQELPEDQIEHEMEAIDPSNKTTPYSIDEKQYNTKKKHGSLQGGAIADVNSITNSLTRLQVVSHETDINEDEEEAHYEDKHVKRALKQRHIGMIALGGTIGTGLFVGISTPLSNAGPVGSLIAYIFMGTIVYFVTQSLGEMATFIPVTSSITVFSKRFLSPAFGVSNGYMYWFNWAITYAVEVSVIGQVIEYWTDKVPLAAWIAIFWVIITLMNFFPVKVYGEFEFWVASVKVLAIMGYLIYALIIVCGGSHQGPIGFRYWRNPGAWGPGIISSDKSEGRFLGWVSSLINAAFTYQGTELVGITAGEAANPRKTVPRAINKVVFRIVLFYIMSLFFIGLLVPYNDSRLSASSAVIASSPFVISIQNAGTYALPDIFNAVVLITVVSAANSNVYVGSRVLYSLARTGNAPKQFGYVTRQGVPYLGVVCTAALGLLAFLVVNNNANTAFNWLINISTLAGLCAWLFISLAHIRFMQALKHRGISRDDLPFKAKLMPYGAYYAAFFVTVIIFIQGFQAFCPFKVSEFFTSYISLILLAVVFIGCQIYYKCRFIWKLEDIDIDSDRREIEAIIWEDDEPKNLWEKFWAAVA

SEQ ID NO: 136 - protein, 586 aa, Saccharomyces cerevisiae
MDKYTNRDHPDYIPGTFNIYSSQNLENGIIYESKLKKTSSGVVLIPQPSYSPNDPLNWSSWRKLAHFGLMAFITAFTAATSNDAGAAQDSLNEIYGISYDSMNTGAGVLFLGIGWSTLFLAPFANLYGRKITYIVCTTLGLFGALWFALAKRTSDTIWSQLFVGISESCAEAQVQLSLSDIFFQHQLGSVLTVYIMCTSIGTFLGPLIAGYISAFTNFRWVGWVAVIISGGLLITIIFGCEETYFDRGQYMTPLTSCQSGYEDGTTLQNSDNTAVSRRKRHLDAKLSTPGAMGEKGVDLSETAEFEVNNEEEVTIPETRELIDGSKEHLKPYPKRVAILTKATNLKGYGFKQYFKYLKINLRMFLFPPVWLSGMFWGIQDVFLTFYLTTQESAYYEPPWNYSDFGVAIMNVPTLIGAVIGCICAGIVSDYFVLWMARHNRGILEAEFRLYFSIATAIIGPAGLLMFGIGTARQWPWQAIYVGLGFVGFAWGCSGDIAMAYLMDCYPDMVLEGMVCTAIINNTISCIFTFTCSDWLAASGTENTYIALAVINFGITAFALPMYYYGKRIRLWTKRWYLQSVNLRDGV

SEQ ID NO: 137 - protein, 606 aa, Saccharomyces cerevisiae
MLETDHSRNDNLDDKSTVCYSEKTDSNVEKSTTSGLRRIDAVNKVLSDYSSFTAFGVTFSSLKTALLVALFLQGYCTGLGGQISQSIQTYAANSFGKHSQVGSINTVKSIVASVVAVPYARISDRFGRIECWIFALVLYTIGEIISAATPTFSGLFAGIVIQQFGYSGFRLLATALTGDLSGLRDRTFAMNIFLIPVIINTWVSGNIVSSVAGNVAPYKWRWGYGIFCIIVPISTLILVLPYVYAQYISWRSGKLPPLKLKEKGQTLRQTLWKFADDINLIGVILFTAFLVLVLLPLTIAGGATSKWREGHIIAMIVVGGCLGFIFLIWELKFAKNPFIPRVYLGDPTIYVALLMEFVWRLGLQIELEYLVTVLMVAFGESTLSAQRIAQLYNFLQSCTNIVVGIMLHFYPHPKVFVVAGSLLGVIGMGLLYKYRVVYDGISGLIGAEIVVGIAGGMIRFPMWTLVHASTTHNEMATVTGLLMSVYQIGDAVGASIAGAIWTQRLAKELIQRLGSSLGMAIYKSPLNYLKKYPIGSEVRVQMIESYSKIQRLLIIVSISFAAFNAVLCFFLRGFTVNKKQSLSAEEREKEKLKIKQQSWLRRVIGY

SEQ ID NO: 138 - protein, 327 aa, Saccharomyces cerevisiae
MSSDTSLSESSLLKEESGSLTKSRPPIKSNPVRENIKSFVAGGVGGVCAVFTGHPFDLIKVRCQNGQANSTVHAITNIIKEAKTQVKGTLFTNSVKGFYKGVIPPLLGVTPIFAVSFWGYDVGKKLVTFNNKQGGSNELTMGQMAAAGFISAIPTTLVTAPTERVKVVLQTSSKGSFIQAAKTIVKEGGIASLFKGSLATLARDGPGSALYFASYEISKNYLNSRQPRQDAGKDEPVNILNVCLAGGIAGMSMWLAVFPIDTIKTKLQASSTRQNMLSATKEIYLQRGGIKGFFPGLGPALLRSFPANAATFLGVEMTHSLFKKYGI

SEQ ID NO: 139 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 140 - protein, 327 aa, Saccharomyces cerevisiae
MASSVPGPIDLPESRYDLSTYWGRIRHCAEISDPTMLLTTEKDLAHAREIISAYRHGELKETTPEFWRAKKQLDSTVHPDTGKTVLLPFRMSSNVLSNLVVTVGMLTPGLGTAGTVFWQWANQSLNVAVNSANANKSHPMSTSQLLTNYAAAVTASCGVALGLNNLVPRLKNISPHSKLILGRLVPFAAVVSAGIVNVFLMRGNEIRKGISVFDSNGDEVGKSKKAAFMAVGETALSRVINATPTMVIPPLILVRLQRGVLKGKSLGVQTLANLGLISVTMFSALPFALGIFPQRQAIHLNKLEPELHGKKDKDGKPIEKVYFNRGI

SEQ ID NO: 141 - protein, 659 aa, Saccharomyces cerevisiae
MPSSLTKTESNSDPRTNIQQVPKALDKNVTNSGNLDSTSSSTGSITEDEKRSEPNADSNNMTGGEPIDPRDLDWDGPDDPDNPHNWSSLKKWYTTMTSAFLCLVVTMGSSLYVSSVPELVERYHVSQTLALAGLTFYLLGLSTVIGAPLSEVFGRKPVYLFSLPVSMLFTMGVGLSNGHMRIILPLRFLSGVFASPALSVGSGTILDIFDVDQVSVAMTYFVLSPFLGPVLSPIMAGFATEAKGWRWSEWIQLIAGGLILPFIALMPETHKGIILRKRAKKRNIALKKFSREAQKEFLKTTVTITILRPLKMLVVEPIVFVFSVYVAFIFAILFGFFEAYAVIYRGVYHMSMGISGLPFIGIGVGLWIGAFFYLYIDRKYLFPKPPAGTQPLTEKERTSKRTTPYRGARDAETGELLPVVPEKFLIACKFGSVALPIGLFWQAWTARSDVHWMAPVAAGVPFGFGLILIFFSVLMYFSTCYPPLTVASCLAANNLLRYVMSSVFPLFTIQMYTKMKIKWASTLFALVCVVMIPIPWVFEKWGSKLRHKSQFGYAAMEKEAETEGGIDDVNAVDGELNLTRMTTLRTMETDPSTREKPGERLSLRRTHTQPVPASFDREDGQHAQNRNEPISNSLYSAIKDNEDGYSYTEMATDASARMV

SEQ ID NO: 142 - protein, 453 aa, Saccharomyces cerevisiae
MIQTQSTAIKRRNSVHKNLFDPSLYQIPEPPRGGFQHQKKEYSKETFSNQVFGYDITSLKKRFTQLFPSNIQGYLPEVDLRITIICSIWYVTSSISSNLSKAILRTFNHPIALTELQFLVSAVLCVGFASIVNLFRLPRLKHTKFSKALNSFPDGILPEYLDGNFRSSILHKFLVPSKLVLMTTFPMGIFQFIGHITSHKAVSMIPVSLVHSVKALSPIITVGYYKFFEHRYYNSMTYYTLLLLIFGVMTTCWSTHGSKRASDNKSGSSLIGLLFAFISMIIFVAQNIFAKNILTIRRKVGILPSSSTDDVTSKEGQPSLDKTRFSPLQVDKITILFYCSCIGFSLTLLPFLTGELMHGGSVINDLTLETVALVAIHGIAHFFQAMLAFQLIGLLSSINYSVANIMKRIVVISVALFWETKLNFFQVFGVILTIAGLYGYDKWGLSKKDGRQA

SEQ ID NO: 143 - protein, 233 aa, Saccharomyces cerevisiae
MSSAITALTPNQVNDELNKMQAFIRKEAEEKAKEIQLKADQEYEIEKTNIVRNETNNIDGNFKSKLKKAMLSQQITKSTIANKMRLKVLSAREQSLDGIFEETKEKLSGIANNRDEYKPILQSLIVEALLKLLEPKAIVKALERDVDLIESMKDDIMREYGEKAQRAPLEEIVISNDYLNKDLVSGGVVVSNASDKIEINNTLEERLKLLSEEALPAIRLELYGPSKTRKFFD

SEQ ID NO: 144 - protein, 627 aa, Saccharomyces cerevisiae
MVNILPFHKNNRHSAGVVTCADDVSGDGSGGDTKKEEDVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 145 - protein, 947 aa, Saccharomyces cerevisiae
MSSTEAKQYKEKPSKEYLHASDGDDPANNSAASSSSSSSTSTSASSSAAAVPRKAAAASAADDSDSDEDIDQLIDELQSNYGEGDESGEEEVRTDGVHAGQRVVPEKDLSTDPAYGLTSDEVARRRKKYGLNQMAEENESLIVKFLMFFVGPIQFVMEAAAILAAGLSDWVDVGVICALLLLNASVGFIQEFQAGSIVDELKKTLANTATVIRDGQLIEIPANEVVPGEILQLESGTIAPADGRIVTEDCFLQIDQSAITGESLAAEKHYGDEVFSSSTVKTGEAFMVVTATGDNTFVGRAAALVGQASGVEGHFTEVLNGIGIILLVLVIATLLLVWTACFYRTVGIVSILRYTLGITIIGVPVGLPAVVTTTMAVGAAYLAKKQAIVQKLSAIESLAGVEILCSDKTGTLTKNKLSLHEPYTVEGVSPDDLMLTACLAASRKKKGLDAIDKAFLKSLIEYPKAKDALTKYKVLEFHPFDPVSKKVTAVVESPEGERIVCVKGAPLFVLKTVEEDHPIPEDVHENYENKVAELASRGFRALGVARKRGEGHWEILGVMPCMDPPRDDTAQTINEARNLGLRIKMLTGDAVGIAKETCRQLGLGTNIYNAERLGLGGGGDMPGSELADFVENADGFAEVFPQHKYRVVEILQNRGYLVAMTGDGVNDAPSLKKADTGIAVEGATDAARSAADIVFLAPGLSAIIDALKTSRQIFHRMYSYVVYRIALSLHLEIFLGLWIAILNNSLDINLIVFIAIFADVATLTIAYDNAPYAPEPVKWNLPRLWGMSIILGIVLAIGSWITLTTMFLPNGGIIQNFGAMNGVMFLQISLTENWLIFVTRAAGPFWSSIPSWQLAGAVFAVDIIATMFTLFGWWSENWTDIVSVVRVWIWSIGIFCVLGGFYYIMSTSQAFDRLMNGKSLKEKKSTRSVEDFMAAMQRVSTQHEKSS

SEQ ID NO: 146 - protein, 300 aa, Saccharomyces cerevisiae
MPHTDKKQSGLARLLGSASAGIMEIAVFHPVDTISKRLMSNHTKITSGQELNRVIFRDHFSEPLGKRLFTLFPGLGYAASYKVLQRVYKYGGQPFANEFLNKHYKKDFDNLFGEKTGKAMRSAAAGSLIGIGEIVLLPLDVLKIKRQTNPESFKGRGFIKILRDEGLFNLYRGWGWTAARNAPGSFALFGGNAFAKEYILGLKDYSQATWSQNFISSIVGACSSLIVSAPLDVIKTRIQNRNFDNPESGLRIVKNTLKNEGVTAFFKGLTPKLLTTGPKLVFSFALAQSLIPRFDNLLSK

SEQ ID NO: 147 - protein, 646 aa, Saccharomyces cerevisiae
MSYESGRSSSSSESTRPPTLKEEPNGKIAWEESVKKSRENNENDSTLLRRKLGETRKAIETGGSSRNKLSALTPLKKVVDERKDSVQPQVPSMGFTYSLPNLKTLNSFSDAEQARIMQDYLSRGVNQGNSNNYVDPLYRQLNPTMGSSRNRPVWSLNQPLPHVLDRGLAAKMIQKNMDARSRASSRRGSTDISRGGSTTSVKDWKRLLRGAAPGKKLGDIEAQTQRDNTVGADVKPTKLEPENPQKPSNTHIENVSRKKKRTSHNVNFSLGDESYASSIADAESRKLKNMQTLDGSTPVYTKLPEELIEEENKSTSALDGNEIGASEDEDADIMTFPNFWAKIRYHMREPFAEFLGTLVLVIFGVGGNLQATVTKGSGGSYESLSFAWGFGCMLGVYVAGGISGGHINPAVTISMAIFRKFPWKKVPVYIVAQIIGAYFGGAMAYGYFWSSITEFEGGPHIRTTATGACLFTDPKSYVTWRNAFFDEFIGASILVGCLMALLDDSNAPPGNGMTALIIGFLVAAIGMALGYQTSFTINPARDLGPRIFASMIGYGPHAFHLTHWWWTWGAWGGPIAGGIAGALIYDIFIFTGCESPVNYPDNGYIENRVGKLLHAEFHQNDGTVSDESGVNSNSNTGSKKSVPTSS

SEQ ID NO: 148 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 149 - protein, 297 aa, Synechococcus sp.
MVAQTFNLDTYLSQRQQQVEEALSAALVPAYPERIYEAMRYSLLAGGKRLRPILCLAACELAGGSVEQAMPTACALEMIHTMSLIHDDLPAMDNDDFRRGKPTNHKVFGEDIAILAGDALLAYAFEHIASQTRGVPPQLVLQVIARIGHAVAATGLVGGQVVDLESEGKAISLETLEYIHSHKTGALLEASVVSGGILAGADEELLARLSHYARDIGLAFQIVDDILDVTATSEQLGKTAGKDQAAAKATYPSLLGLEASRQKAEELIQSAKEALRPYGSQAEPLLALADFITRRQH

SEQ ID NO: 150 - protein, 778 aa, Zea mays
MAQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 151 - protein, 785 aa, Arabidopsis thaliana
MSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 152 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 153 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 154 - protein, 500 aa, Stevia rebaudiana
MEASYLYISILLLLASYLFTTQLRRKSANLPPTVFPSIPIIGHLYLLKKPLYRTLAKIAAKYGPILQLQLGYRRVLVISSPSAAEECFTNNDVIFANRPKTLFGKIVGGTSLGSLSYGDQWRNLRRVASIEILSVHRLNEFHDIRVDENRLLIRKLRSSSSPVTLITVFYALTLNVIMRMISGKRYFDSGDRELEEEGKRFREILDETLLLAGASNVGDYLPILNWLGVKSLEKKLIALQKKRDDFFQGLIEQVRKSRGAKVGKGRKTMIELLLSLQESEPEYYTDAMIRSFVLGLLAAGSDTSAGTMEWAMSLLVNHPHVLKKAQAEIDRVIGNNRLIDESDIGNIPYIGCIINETLRLYPAGPLLFPHESSADCVISGYNIPRGTMLIVNQWAIHHDPKVWDDPETFKPERFQGLEGTRDGFKLMPFGSGRRGCPGEGLAIRLLGMTLGSVIQCFDWERVGDEMVDMTEGLGVTLPKAVPLVAKCKPRSEMTNLLSEL

SEQ ID NO: 155 - protein, 707 aa, Stevia rebaudiana
MQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYSSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 156 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 157 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 158 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 159 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 160 - DNA, 1536 bp, Artificial Sequence
  Codon-optimized KO
atggctaccttgttggaacattttcaagctatgccattcgctattccaattgctttggctgctttgtcttggttgtttttgttctacatcaaggtttctttcttctccaacaaatccgctcaagctaaattgccaccagttccagttgttccaggtttgccagttattggtaatttgttgcaattgaaagaaaagaagccataccaaaccttcactagatgggctgaagaatatggtccaatctactctattagaactggtgcttctactatggttgtcttgaacactactcaagttgccaaagaagctatggttaccagatacttgtctatctctaccagaaagttgtccaacgccttgaaaattttgaccgctgataagtgcatggttgccatttctgattacaacgatttccacaagatgatcaagagatatatcttgtctaacgttttgggtccatctgcccaaaaaagacatagatctaacagagataccttgagagccaacgtttgttctagattgcattcccaagttaagaactctccaagagaagctgtcaactttagaagagttttcgaatgggaattattcggtatcgctttgaaacaagccttcggtaaggatattgaaaagccaatctacgtcgaagaattgggtactactttgtccagagatgaaatcttcaaggttttggtcttggacattatggaaggtgccattgaagttgattggagagattttttcccatacttgcgttggattccaaacaccagaatggaaactaagatccaaagattatactttagaagaaaggccgttatgaccgccttgattaacgaacaaaagaaaagaattgcctccggtgaagaaatcaactgctacatcgatttcttgttgaaagaaggtaagaccttgaccatggaccaaatctctatgttgttgtgggaaaccgttattgaaactgctgataccacaatggttactactgaatgggctatgtacgaagttgctaaggattctaaaagacaagacagattataccaagaaatccaaaaggtctgcggttctgaaatggttacagaagaatacttgtcccaattgccatacttgaatgctgttttccacgaaactttgagaaaacattctccagctgctttggttccattgagatatgctcatgaagatactcaattgggtggttattacattccagccggtactgaaattgccattaacatctacggttgcaacatggacaaacaccaatgggaatctccagaagaatggaagccagaaagatttttggatcctaagtttgacccaatggacttgtacaaaactatggcttttggtgctggtaaaagagtttgcgctggttctttacaagctatgttgattgcttgtccaaccatcggtagattggttcaagaatttgaatggaagttgagagatggtgaagaagaaaacgttgatactgttggtttgaccacccataagagatatccaatgcatgctattttgaagccaagatcttaa

SEQ ID NO: 161 - protein, 511 aa, Rubus suavissimus
MATLLEHFQAMPFAIPIALAALSWLFLFYIKVSFFSNKSAQAKLPPVPVVPGLPVIGNLLQLKEKKPYQTFTRWAEEYGPIYSIRTGASTMVVLNTTQVAKEAMVTRYLSISTRKLSNALKILTADKCMVAISDYNDFHKMIKRYILSNVLGPSAQKRHRSNRDTLRANVCSRLHSQVKNSPREAVNFRRVFEWELFGIALKQAFGKDIEKPIYVEELGTTLSRDEIFKVLVLDIMEGAIEVDWRDFFPYLRWIPNTRMETKIQRLYFRRKAVMTALINEQKKRIASGEEINCYIDFLLKEGKTLTMDQISMLLWETVIETADTTMVTTEWAMYEVAKDSKRQDRLYQEIQKVCGSEMVTEEYLSQLPYLNAVFHETLRKHSPAALVPLRYAHEDTQLGGYYIPAGTEIAINIYGCNMDKHQWESPEEWKPERFLDPKFDPMDLYKTMAFGAGKRVCAGSLQAMLIACPTIGRLVQEFEWKLRDGEEENVDTVGLTTHKRYPMHAILKPRS

What is claimed is:

1. A recombinant host cell producing a steviol glycoside in a cell culture, wherein the recombinant host cell has a modified expression of at least one endogenous transporter gene encoding a transporter polypeptide, wherein the modified expression comprises increasing expression or activity of the at least one endogenous transporter gene encoding the transporter polypeptide having at least 95% sequence identity to the amino acid sequence set forth in SEQ ID NO:26 above the level of expression or activity observed in a corresponding unmodified recombinant host cell;
   wherein at least a portion of the steviol glycoside is transported from the recombinant host into the cell culture; and
   wherein the host cell is a plant cell, a fungal cell, or a bacterial cell.

2. The recombinant host cell of claim 1, wherein the transporter polypeptide comprises an ATP-binding cassette (ABC) transporter polypeptide.

3. The recombinant host cell of claim 1, further comprising:
   (a) one or more genes encoding a sucrose transporter (SUC1) polypeptide and a sucrose synthase (SUS1) polypeptide;
   (b) a gene encoding a polypeptide capable of synthesizing geranylgeranyl pyrophosphate (GGPP) from farnesyl diphosphate (FPP) and isopentenyl diphosphate (IPP);
      wherein the polypeptide comprises a polypeptide having at least 95% sequence identity to the amino acid sequence set forth in SEQ ID NO:149;
   (c) a gene encoding a polypeptide capable of synthesizing ent-copalyl diphosphate from GGPP;
      wherein the polypeptide comprises a polypeptide having at least 95% sequence identity to the amino acid sequence set forth in SEQ ID NO:150;
   (d) a gene encoding a polypeptide capable of synthesizing ent-kaurene from ent-copalyl pyrophosphate;
      wherein the polypeptide comprises a polypeptide having at least 95% sequence identity to the amino acid sequence set forth in SEQ ID NO:152;
   (e) a gene encoding a polypeptide capable of synthesizing ent-kaurenoic acid from ent-kaurene;
      wherein the polypeptide comprises a polypeptide having at least 95% sequence identity to the amino acid sequence set forth in SEQ ID NO:151;

(f) a gene encoding a polypeptide capable of synthesizing steviol from ent-kaurenoic acid;
   wherein the polypeptide comprises a polypeptide having at least 95% sequence identity to the amino acid sequence set forth in SEQ ID NO:154;
(g) a gene encoding a polypeptide capable of reducing cytochrome P450 complex;
   wherein the polypeptide comprises a polypeptide having at least 95% sequence identity to the amino acid sequence set forth in SEQ ID NO:153 or 155;
(h) a gene encoding a polypeptide capable of glycosylating steviol or a steviol glycoside at its C-13 hydroxyl group;
   wherein the polypeptide comprises a polypeptide having at least 95% sequence identity to the amino acid sequence set forth in SEQ ID NO:156;
(i) a gene encoding a polypeptide capable of beta 1,3 glycosylation of the C3' of the 13-O-glucose, 19-O-glucose, or both 13-O-glucose and 19-O-glucose of a steviol glycoside;
   wherein the polypeptide comprises a polypeptide having at least 95% sequence identity to the amino acid sequence set forth in SEQ ID NO:158;
(j) a gene encoding a polypeptide capable of glycosylating steviol or a steviol glycoside at its C-19 carboxyl group;
   wherein the polypeptide comprises a polypeptide having at least 95% sequence identity to the amino acid sequence set forth in SEQ ID NO:157; and/or
(k) a gene encoding a polypeptide capable of beta 1,2 glycosylation of the C2' of the 13-O-glucose, 19-O-glucose, or both 13-O-glucose and 19-O-glucose of a steviol glycoside;
   wherein the polypeptide comprises a polypeptide having at least 95% sequence identity to the amino acid sequence set forth in SEQ ID NO:159 or 148;
   wherein at least one of the genes in items (a)-(k) is a recombinant gene; and
   wherein the steviol glycoside is Rebaudioside A, Rebaudioside B, Rebaudioside D and/or Rebaudioside M or an isomer thereof.

4. The recombinant host cell of claim 3, wherein at least one of the genes in items (a)-(k) is codon optimized for expression in the recombinant host cell.

5. The recombinant host cell of claim 4, wherein at least one of the genes in items (a)-(k) is codon optimized for expression in *Saccharomyces cerevisiae*.

6. The recombinant host cell of claim 1, wherein the bacterial cell comprises *Escherichia* bacteria cells, *Lactobacillus* bacteria cells, *Lactococcus* bacteria cells, *Cornebacterium* bacteria cells, *Acetobacter* bacteria cells, *Acinetobacter* bacteria cells, or *Pseudomonas* bacterial cells.

7. The recombinant host cell of claim 1, wherein the fungal cell is a yeast cell.

8. The recombinant host cell of claim 7, wherein the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous,* or *Candida albicans* species.

9. A method of producing a steviol glycoside in a cell culture, comprising culturing the recombinant host cell of claim 1 in a culture medium, under conditions in which one or more of the genes are expressed;
   wherein the at least one endogenous transporter gene is expressed;
   wherein culturing includes inducing expression of one or more of the genes or constitutively expressing one or more of the genes; and
   wherein the steviol glycoside is produced by the recombinant host cell.

10. The method of claim 9, wherein:
(a) Rebaudioside A is produced in the recombinant host cell expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside;
(b) Rebaudioside B is produced in the recombinant host cell expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; and the polypeptide capable of beta 1,2 glycosylation of the C2' of the 13-O-glucose, 19-O-glucose, or both 13-O-glucose and 19-O-glucose of a steviol glycoside;
(c) Rebaudioside D is produced in the recombinant host cell expressing the polypeptide capable of glycosylating steviol or the steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside; and/or
(d) Rebaudioside M is produced in the recombinant host cell expressing the polypeptide capable of glycosylation of the 13-OH of steviol; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

11. The method of claim 9, wherein the steviol glycoside is produced at a concentration of at least 500 mg/L of the cell culture.

12. A method of increasing production or transport of a steviol glycoside into a culture medium, comprising culturing the recombinant host cell of claim 1 in a culture medium, under conditions in which one or more of the genes are expressed;
   wherein at the least one endogenous transporter gene encoding the transporter polypeptide, the at least one endogenous transcription factor gene encoding the transcription factor polypeptide that regulates expression of the at least one endogenous transporter gene, or both are expressed;
   wherein culturing includes inducing expression of one or more of the genes or constitutively expressing one or more of the genes wherein the steviol glycoside is produced by the recombinant host cell; and wherein the steviol glycoside is RebA, RebB, RebD or RebM or an isomer thereof.

13. The method of claim 12, wherein the steviol glycoside is Rebaudioside A, Rebaudioside B, Rebaudioside D and/or Rebaudioside M or an isomer thereof.

14. The method of claim 9, that further comprises isolating the Rebaudioside M, alone or together with at least one other steviol glycoside from the cell culture.

15. The method of claim 9, wherein the isolating step comprises separating a liquid phase of the cell culture from a solid phase of the cell culture to obtain a supernatant comprising Rebaudioside M, alone or together with at least one other steviol glycoside, and:
  (a) contacting the supernatant with one or more adsorbent resins in order to obtain at least a portion of Rebaudioside M, alone or together with at least one other steviol glycoside; or
  (b) contacting the supernatant with one or more ion exchange or reversed-phase chromatography columns in order to obtain at least a portion of Rebaudioside M, alone or together with at least one other steviol glycoside; or
  (c) crystallizing or extracting Rebaudioside M, alone or together with at least one other steviol glycoside;
  thereby isolating Rebaudioside M, alone or together with at least one other steviol glycoside.

16. The method of claim 9, that further comprises recovering a steviol glycoside composition comprising Rebaudioside M, alone or together with at least one other steviol glycoside from the cell culture.

17. The method of claim 16, wherein the recovered steviol glycoside composition is enriched for Rebaudioside M relative to a steviol glycoside composition of *Stevia* plant and has a reduced level of *Stevia* plant-derived components relative to a steviol glycoside composition obtained from a plant-derived *Stevia* extract.

18. The method of claim 9, wherein the cell culture comprises:
  (a) the steviol glycoside produced by the recombinant host cell;
  (b) glucose, fructose, sucrose, xylose, rhamnose, uridine diphosphate (UDP)-glucose, UDP-rhamnose, UDP-xylose, and/or N-acetyl-glucosamine; and/or
  (c) supplemental nutrients comprising trace metals, vitamins, salts, yeast nitrogen base (YNB) and/or amino acids.

19. The method of claim 9, wherein the recombinant host cell is grown in a fermentor at a temperature for a period of time, wherein the temperature and the period of time facilitate the production of the steviol glycoside composition.

20. A cell culture, comprising the recombinant host cell of claim 1, the cell culture further comprising:
  (a) the steviol glycoside produced by the recombinant host cell;
  (b) glucose, fructose, sucrose, xylose, rhamnose, uridine diphosphate (UDP)-glucose, UDP-rhamnose, UDP-xylose, and/or N-acetyl-glucosamine; and
  (c) supplemental nutrients comprising trace metals, vitamins, salts, YNB, and/or amino acids;
  wherein the steviol glycoside is present at a concentration of at least 1 mg/liter of the cell culture.

21. The recombinant host cell of claim 1, wherein the recombinant host cell is a *Yarrowia lipolytica* cell.

22. The method of claim 9, wherein the recombinant host cell is a *Yarrowia lipolytica* cell.

23. The method of claim 9, wherein Rebaudioside A is produced in the recombinant host cell expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

24. The method of claim 9, wherein Rebaudioside D is produced in the recombinant host cell expressing the polypeptide capable of glycosylating steviol or the steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

25. The method of claim 9, wherein Rebaudioside M is produced in the recombinant host cell expressing the polypeptide capable of glycosylation of the 13-OH of steviol; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

* * * * *